United States Patent 12,746,261 (PROBIOTIC BACILLUS COMPOSITIONS AND METHODS OF USE) - sequence listing, part 3

SEQ ID NO: 5 - DNA, 4090715 bp, Bacillus amyloliquefaciens (residues 1-2,045,358 of 4,090,715)
catcatatactgggccgtcgggagtaacgatattgactttaacggtcttcatgcttttaccctcctaggaccagattaaacttctacacccatctcttttgcattctcaatgacttcttcaatgcgtcccacaagacggaatgcatcttccggaagatggtcatatttaccggaaaggatttctttaaagcctcgtaccgtttctttaacaggcacgtaagaacccttttgtcccgtaaactgctcagctacgtggaagttttgagaaaggaagaactggatacggcgtgcgcggtgaacgacaagcttgtcttcttcacctaattcgtccataccgagaatcgcgataatatcctgaagttctttgtaacgctgaagcgttgactgaacttcacgcgccaccgcataatgctcttctccgacaatttccggagcaagcgcgcggaagtggaagccagcggatcaaccgcagggtagatacccatttcagttaatttacgctcaaggttagtcgttgcatccaagtgagcgaacgttgtcgccggagccgggtcagtgtagtcatcggcaggcacgtagatcgcctggatagatgtaactgaaccaacgtttgtagacgtaatacgctcttgaagctgacccatttctgtcgcaagcgtcggctgataaccaaccgcagaaggcatacggccgagaagcgcggaaacctctgaacccgcttgtgtgaaacggaaaatgttatcgataaagaacagtacgtcctgtccttgtttatcacggaaatgctcagccattgtaagacccgtcagtgctacacgcatacgtgcgcccggcggctcgttcatctgtccgaagaccatggctgttttcttgataacgcctgaatcgctcattcgtagaaaaggtcgttcccttcacgagtacgctctcctacaccggcgaatacggaaataccgccgtgctcttgcgcgatgttgttgattaattcctggattaatacggttttacctacgccggcgccgccgaacaatccgattttaccgcccttgatgtaaggagcgagcaggtcaacaaccttaatccccgtttcaagaatttcaacctcagttgaaagctcatcgaatgaaggagctgatctgtggatcgggtccttttgagcatccgcaggcagcggttcatttaaatcaattttatctcccagtacgttaaatacgcgtccgagagtcacatcaccgactggaacggaaatcggcgcacctgtatcaacggcttccattccgcgctgaattccgtccgtagatgccatggcaattgtacggactgtatcatcgcctaaatgaagagcaacctctagcgttaggtcgatgcctacttcattttcgcctgtagctggctgtgaaactttaatcgcattataaatcgcaggcaagtggccgtcctcgaaacgtacgtcgacaaccggtccaagcacctgacttacgcgtcctttcttcatcgctatccctcctgacaaaatctttctattctaaagcggctgcaccgccgacaatttcggtaatttcttgtgtaatcgccgcttgacgcgcgcggttatatgaaagcgaaagtgaatcaatgagttctttcgcattatcagtcgcatttttcattgctgtcattctcgcagcgtgttcacttgctttactgtcaagaagcgcgccgtaaattaagctttccgcatattgaggaagcagcacttcgagcacctcttcttcatccggttcgaactcgtaagaagccgtgcgcttcccgccgctcgttccgaaatccgttaaaggcagcacttttttctccgtcacttcctgtgaaatcgcactgacgaaatggttatacaccaaatgcagttcatcaaaagcgccgtcgataaacatttgaaccgtctgacgggtcaaatctttaatctgagcaaaagtgacctcgtcgccaagccccactaactcagacaaaatcggcatctcccgttttttgaagaaatcgcggccgactctgccgattgcaatcaccgtgtattcatctttagactgatggcgttcttgaatggtgcggtaagcgtttcgcaaaaccgaactgttaaacgcacccgcaagcccgcggtcagacgtaatgacgagatacgccgtctttttcacttctcttgagacaagcatcgggtgtttcgcgtttttcgcgccttttccgacgttaaacacaacctcctggatctatccatatacggagcaaatgacttcgcgttggtttccgcacggttcagcttcgcagcggataccatctgcatggcttttgtaatctggcttgtttttttcgttgacgtgatccttgacttaatatcgcgtaatgaggccaaagatttcaccacctttattcttcatttgcgtaaaaagagagaaaagagaacctttttctctcatcttctaagggttagttgcttggtgcaaatgtgcgtttgaagccttcgattgcagctttgaagtcttcatcagcaggaaggtttcctgttttcgcaatgccgtcaagcagatctttatggttttgatcaaggtacatgtagtactcttcttcaaaacgtctgatatccgcaaccggaatatcatcaagatatccttttgtcagcgcataaagaatggctacctgtttttcaaccggaagcggcttattcaagtcttgcttcagcacttcaactgtacgcgcaccgcggttcaatttcgcctgagtcgcctggtcaagatcagatccgaattgggcgaatgcttcaagttcacggtatgaagcaaggtcaagacgcaatgttccagctacctttttcatcgctttgatttgggctgacccgccgacacgggatacggataatccggcattgatcgcaggacgcacgcctgagaagaatagatcggattgaaggaaaatctgtccgtcagtaatggaaatgacgtttgtcgggatataagcggagatatctcctgcttgtgtttcgacgaacggcagcgccgtaattgatcctgcgcctttagcgtcactcagcttggctgcgcgctcaagcagacgggagtgaagatagaatacatccccagggaatgcttcacggccggcggacggcgaagaagcaatgacagctcacggtaagcggccgcttgtttggaaatcatcatatacgacgagaacgtgcttgccgttgtacatgaattcttcacccattgtcacccctgcatacggtgcaaggtaaagaagcggagccggctgtgaagcggatgccgtcacgacaatcgtgtaatcaagcgcgccgtgcttacgaagtgtttccaccacgccgcgtactgtagattctttttggccgatcgctacgtacacacagatcatgtcttgatctttttggtttaagattgtatcaatcgcaacagatgttttacctgtctgacgatccccgataatcagttcacgctgtccgcggccgatcggaattaacgcgtcgatcgctttgatacccgtttgcagcggctcatgtaccgatttacggtccattacgcctggagcctggctttcgatcgacgtgttttgcttgtcagaatcggacccagtccgtctaccggctgtccgagcgggttgacgatacgtccgattaattcttcacctacaggaacttccatgatgcggcccgttcttttgacctcatcaccttcgcggatatctctgtaaggtcctaagataacgatacctacgttggattcttcaaggttttgagccatacccaaaacgccgtttgaaaactcaacaagttcaccggccatacaattgtcaaggccgtgtacacgcgcaataccgtctccgacttggatgactgtacctacgtcatgaacttcaatttcagattggtaattttgaatttgctgctttatcagcgtgctaatctcttcagctttgatgctcacttaggtttcaccccttctatcgatttccccggcaagttgacgttccatgcgctcaagctttccgcttacgcttccgtcataatccggtttccaatgcggactttaatgccgcctattaaatccgtctgcacttcatttctgattctgagcgaagcgattccggctttttttgcaaacacttgagacaatgataacatttccgcttctgaaagcggctttactgaataaacaaccgcgtcctctgtctgacgggcctgattggcaagtttgataaactcgtctgtgagatcaggcacaatcgaagaccggcggcggtcaatcagaagaaaaatcgtatgcagcacagactcagacagtgcgccgaacgattgctgaatcagctctttttcttagcggccgataccttcggatggcttagcacttcctgtaatccggcttcgtttcggaacacttctttagtacggtaagctcttcttcgatttcattgatttgagaagtctcaacggcaatgtcgaaaagcgctgacgcgtatcgtttagagacagcagatccactcatcggctttctcctacctctttaagatagtcctgaatcagttgttcctgggcttgttcatcaagctctttttcaatcactttcgatgcgattaagacagaaagtgatgcgacttgctcgcgaagtgcggaaaccgcttgttctttttctttgacaatttcggttctcgccgcttctttcaatctttcagactcggcgcgtgcagcctggataatgtcttccttctgcttttcacccagttttttcgcattttcaatgagtgattgtgattcctgtttcgcttcttttaaaagaacgcgctgctcttcaatcagcttctgcgcttctttatttctttcttcagcggacgtaatttcgccggcgatatgatcttcacgctgtttcattatattttaatagcggtcccagagcgaatttcttgagaagcgctaataaaactaacatagctaacaattggaataggatatctccgccgttaaacgacagtcctaattcaagaggtaattgagacatctactacggcaactcccttctgcaggttttctctgctgataaaaagccgtttcgggacggcctgcttatcagacataaagcaatggcgaaggttctcttagagtgatcttcgccattttagttcatataaggcttttttgcttagccaaagaacgctaagaacgcgataacgacagcgataatcggaagggcctcaaccaatgcgatacccatgaacataagagttctaagttcttttcctgcttccggctgacgggcgattccctctaccgtacgtgaaacgatcagaccgttaccaatacctgcaccaagtgcacctaaaccgattgcaattgcagctgctattaaattcatgaaaaagttcctcctttaaaatgttatccgaatggatatatgattttaatgatcatgactgattttgtgtgacatgtacaccatcgtcagcatcgtaaagataaatgcctggatggtaccgatgaacaagctgaatgcctgccatgcaagcatcggaataatggctccgactgtgccgaccaaccgagaaagaaactgtttgagtagaaattcgtcgccagattcgcaagcaggccaagaagaatttcccggcgaaaatttaccgtaaagacgaagtccgagtgtcagcgtattcgcaaactcctcaatgatcttcatcgggaacataagcggaaccggtctgaggtaatccttagagtattccttcaaacctttcatcttcacgccgtaatagtgcgttaacgacacaaccataacggctagagtcagagtaatagccggatcagccgtcggtgatttccaccaaagctcgtgtccgaccgttacagaaaacggcagccctagcatattgatacaaatatgtaatcagcaggttacaccaagcgccaagaagttagcccctgtttttaaatccattgtactgcctataatattgcggacaaatcaacaatccattccatgaagttctgggcttttcccggacggatggacagcgttcttgtagtaagaatcgcaatcagcagcacaatcacacttgccacagtaatcatcagaatgtttgtcagattaaaagtaagaccaaacaaatcaatagttctgtaatcgtgattcaatgggttttcacctctcttccattgatgaacgtttgagctgataatggaatctatcataatgacgggataaattgtcattaatccaataatcacacttgccacactgactttatcgggatatttaaaggcgacagccatcgcaagtatcgcattgcaccaacgcgctgcgctcccgagtgatcgtatggactttcctttcgccacggccttgtcaaaagcattcattcttctggtcaagagccacaaattaaacaaactgaaaacagttccaaaaagaggcctaaaaaaacagttttatacgccgtaagaccatatcccagcaaatagattgctaagattacaaatacatatctccgttgtctgctgaatgtaagattgggatcgtccatcaactatctgtctcctgatgaaaatgtaatataattcctggatacggcaaaacatgcggttaacccttgcagaaggcttttttgtccgcaaaacggcctgttcgaaaaaaccactcatcctcctgatgctacgggatgctgtttcattcgcttagataaatcctcatataacgggtttttttggaggatttaaaatgaggatggatactagaaatgaaaggaatgaaaaccttctcataataccctcgtttagcatacaatagccctaacatgtgtcaatctgtttaaagttaaaaaactttttataccggagcatacacagaatgttcacaattcacctataaatgtatgacctctgccattcagctaaaatctggataaaaaaagaaaacccctgaatgaggttttccgatttatttggttccgtacagtctgtcaccgcgtcaccgaggcccggaacgatatagcctttttcattcagtttttcatcaagggcggcgatataaatatcaacgtcagaatgatgtttctgcagctcttccacgccttccggagccgctacaagacacataaaacgaatgtttctcgcgccgcgctttttcaggctgttgatcgcttccaccgcagagcctcccgtagcaagcatcggatccacgacaataaattcgcgttcttctacatcagaaggaagcttgacatagtattccaccggttttaaggtttccggatcacggtataatccgacatgtcccactttagcggccgggattaatttcagcatgccgtcaaccattccgagacccgctctcaggatcggcacgataccgagtttcttccctgaaatcactttggatgtcgctgtttgaacaggtgtttcacttccacttctttaagaggaagatcacgtgtaatttcaaacgccatcagtgatgcgacttcatccacaaggtctctgaaatcctttgtgcctgtattttcattccgaatatatgtcagcttatgctggattaaaggatgatcaaatacgtaaacctttcccatactgtgttcagctcctttttgttgtccgagtgactttttcacacttctattgattctacagaaaaagacaaacagtttcaagaaaatcataaaaaaacccgccggattaaggttccggcgggtttcttccttattaatagtccagttctttatataaaggaaacttttcagtcaaggcagatacgcgctgtttcgcttcttcaagttttgcttcgtcttcatgattttcagcgcgaggccgatgatggcgccgacttcttcaagcgcgtcaccgtcaaagccgcggcttgtcacagccgccgtaccgagacggattccgcttgtgacgaacggtttttccggatcgtaagggatcgcgtttttattagatgtaatgccgatttcatcaagaacgtgttcagcgacttttccggtcagtccgagagaacggaggtcgacaagcacaaggtggttatccgttccgcctgatacgagctgaataccctctttgttcagagactcagccaggcgcttcgcgttcgagatgacgttttgcgcatatgttttgaaatcatcttcaagcacttctccgaaagaaacggcttttgccgcgatgacatgcataagcggtccgccttggattcccgggaaaatggatttatcaatcttcttgccgaactcttcacggcaaaggatcattcctccgcggggtccgcgaagtgttttgtgagtcgttgtcgttacaaagtcagcgtaaggaaccggattcggatgaaggccggctgcgacaagacccgcgatatgcgccatgtctaccatgaagtaagcgccgacttcatcagcgatttcacggaattttttaaagtcgatcgtgcgggggtatgcgctcgctccggcaacgatgagtttcggcttatgcgccagcgctttttcacgcacatcttcataatctatatattgcgtgtctttatcgacaccgtattctacaaagttgtattgaacgccgctgaaattaaccgggcttccgtgtgttaagtggccgccgtgggagaggttcatcccgagcaccgtgtcgccgtgctctaaaatcgtgaagtaaacagccatgttcgcctgagcgcctgagtgcggctgaacgtttacatgctcagctccgaaaatctctttcgcgcggtcgcgggcgatgtcctcaacgacatcaacatgctcacagccgccgtagtagcgtttgccgggtagccttcagcatatttgtttgttaaaacagagccttgtgcttccattaccgcttccgtcacgaagttttcagaagcaattaattcgatcttagtctgttgacgcttacgctcatctttgatggcgttaaacacttgtttatcttgtacaggtaaatgtttcatcagcgagatcctctcctatccgtttcctgttctttatttttaccaccttattgtacatggtttttcaggtgaatgtaacagcttatttaaaaaaatcacaaaatttaattagaaaacacgaacattatagaggaaaagtattttcatcattcgcattcatatacggcgcgaattccgcctatcagcttcggtcttgtccgggccatcgtcacatgtgcttctccaagctcacggctcgatatccggacagggacggcaacgggtttcagatgcatgccgatgaacgtatcaccgatgtcaatcccggcgtcagcctgaatcgattcagcgagcactggagaacgcatctgccggtatgcataagaggccatcgctccgcccgctttcgggacggggacggctgaaacaatggggagcctgaaccgctcggccgtttccgcttcaatgacaagcgccctgtttaaatgctcgcagcattgaaaagcaagatgcacacccgttttttccttaaaccggttaagtccgccgtatatcaattcagcccaatccccgcttccggcggtgccgatccggcttccggcggcttcacttgtactgcacccgaccaccagcagactgccgtccgtcagtcctgcctgctcttgaaactcagtcagcatgtccgtccatttttgcttcatctcttccattgtccagcacctcttacagatttttttcttcgtaatctgcgattttgccgatccgccgttcgtggcggccgcccgtaaattcagtcgtcagccagacttttgcgatttcgcgcgccagccccgggccgatgacgcgttcgcccatcgcaagaacattcgtgtcattgtgttcacgcgtcgcttttgcgctgaaggtgtcatgggcaagcgcacagcgtatgcctttaccttatttgcggagatgctcatgccgatgcctgtgccgcaaattaaaattcccctgtcagcttcgccgttcaccactttttccgctaccggaaaagcgtagtctgaataatcgacagagccggcgccgcattcacagccatatcaatgtattcaatctgcaattcatccaaaagactttttatttcttcgcggatatggacgccgccgtgatctgacgcaatagctactttcattcatttacctcctaggtgtggctgggcgaagacagcccagtgtgcttgtcctttttattacgaaatccgttgatttcattctactctttcacattcgttttgcaaatgacctgtttgcagattttctgacagattacttgcttttcccgtcaagcaattgatcagccaaaagggtcagcagctcctccagttcgtcccgcgtctgtttataaacatcaagcggaccgccgaacgggtcagagatatcgccgctttcccccgtcacgtattctttaatggtaaaaactttgccctgactgttttgatatcggccttcaatcagctgtttatgctgttcggtcatcgccagcaccagatcggccgtctcgatatgttcttccgataagggagatgaactgtgattgagggcgatccgtttttcaaacagcgcttctacggcatgagccgacgcttttccgtgcggagacgcgaatacgccggccgagcttacgctgacatccagccctttcgtttctgctatggatttaaaaagagcctcagccatgggactgcggcacgtattgcctgtacaaacaaagattattttcatgtccgtcacctcttactacctattataaatgaagaaaaagaaacggcatcttcgtttctttttttacgtatcttatatcggtaaaagcagtttcagcccgaatccgatcaaaatggctccgccaagcgcttcgctgtaggagccgagccatgactgcacctttcttcccgccaaaaggcccgcccatgttaaaacggtgctgaagaccccgaacagcgtaacggccagaaacggattggagccgttcatcccgagactgagcccgacagaaaagctgtccagactgacaccgaccgcaaacagcaacagtcccgagcctgccggagatatgagcggcccgtccgattgtttaaacgcggcgatcatcatctgcacccctaaaatgaaaagaagagatccgccgatgtaaacggcgagcatcccagaaaaccggacagcagatgcccggccgccattcctacaagcggcatcatgacatgaaacagcccgatgacaacccctatatgaaaaatctgttttttcttcagctgaatcattcccattccgagcccgacggaaaaggcatccgtcccaaagcaaatgccatgatgcttaaggagacaagttccccgatgaatagattcgacatgaataaaaaccccttggacgtgcccgcttgtttagcttatgcatgtccgataaggggtagaacaagttaatggataacggtgccgcctgcggctttcatcagcctgttcataacggcgagccccactccggtatccggaaaggactcagaaataatcatatccacttccgcttcatcaaagctgcggagcgcatcgtataaggcggacgccactgtttcaaggtcggcgcgtctgccgcagaccttgatataatcagcctggtaactatcggcgttctcttctgttgtcaaaatgccgattcgttttccccggcttttatatgcgtctgccagttcttgaattctccgggcgccgccgtcggcaatagccatcggcgcagaaggcgcgtaatgtgtatatttcataccgggagaaataggaacctcatcttcttcggtcagtcctttatccacaagaaccggaccggcggcggattcaatctgctcttttgtcacgccgcccggacgaagcagcacgggctgtttccccgtacaggacagaacggttgattccactccgattcccgtcgcgccgccgtccacaataccggcaatacggccgtttaaatcatgagctacatgctcggccttcgtcgggctcggttttcctgataaattggcgctcggcgcggcgatcggcagtccggccgagctgatgagggctaatgctgccggatgatcaggcattctgaccgctaccgtctccagtcccgcggtgacacggggtgacagcacaccgggcttacacggcaggacaagggtcagcgcccccggccagaatagctccataagctttttcgccgtctcaggaatatggctgataaaacgatcaagctggctgatatgggatatatgcacaatcagcgggttatcgctcggccttcctttcgcctcatatattttcgttacggcttccgtattttcagcgttagcgcccagtccgtaaacggtttctgtcggaaaagccacaacctcattctgccggagcaattccgcggcttgtgtaatttggggatcggttgtggataattctgcggaacaatccacaaaccatcttcttgttttcatgtataaccaaactccttattttaaagcggtaaaactttattttctctcgtgtattccttttgaaagtataaaagatgtcctttaataaaacaagcgttatccacaaactgtggacaacactttttaataagtggataaccttgtgtataagttagatcaggcagaggttttcaccattaaaaacgaaccttctgtgcataacgagttgcggaaatgttcggacgtatacagttcctcaggcgcatcggcgcacgcttcaaatcccatcacattcagaaactcagcagatgagggctgattggcgactaagtagacatcttgaatttcatgttttttgcacagcacatccatactttgaaacagtgtaacgatatggctttgattcagcctgtccgacatgacgagtgaacggagaagcccttttccgccgctgaatttttcgatcccgagacaggcggcaatctttttttcgctgtcttccagcacgataaaccggctgatctgctgatcgatttccgcatgtgccgtatcagactttttcaaaaaggcctccagcgcctccgtatcttgatctcttgccactctcagctgataaaacatatatttccctccgtttcgatcaactctttcttccaatctatgaatcgaatccggatttatgccttttgcttcaggaaaatagatctgaaatccaatcgacgaggaaaaacttcacttcggtatcatcgtcatctttattttctttcttcgctttatcggcctttgcttttacgtcatccagcactttttctgtctgtttctgcgtttcttcctgcttctgtccgccgtcttcctgatctttcaccgcttcgccgtttgagaaatcaaggaagcacagcggcggaaacaagacgcaccaccagttggcgccctcgccattgccgagtgtaattaaaatggcttcatattttccggccggatagaccatattgccgtacagctttgtcggaaacgagattttattgaattgaactgaaacggattgatgcgcacccttttctttcatcgtttgtttggcgatttctttaatttcaggaagcttcgaacgaatgagccgccgcgcttcttcaatggaagtgatatctttcacccagtccgtgatttgcttgtttacagcatctctgatctggcgcttgagcttttgatcctcatcgttatcactgttggccaaaatcctgagccggatcgcttcatccggtatgacgacgggctcatcggctgatgcccgcgccgtttcttcttttgtcaaacccgcaagcgctcctgataataaaagaaaaatatatatgcagatcatcattgtctgtttcatcggtccccaccgttcctctccgtgctttttttatctagtcccattatggacatgacggaaaaggtttaaaccggcgggaagaaaaaaatctagcaagctgataatctgcattgacagattcaaaatatggtacgatattattttgataggaggttttcagatgaaatataattacaccgtgctgctgtcggcggcatgtatgtctgtcatttattctattttgtatgttcatcaattcattatcgcggctttcatttcgatggcgttttattttttgtttccttatttgatttttgcgctgccgcttcaatactttctgaataaaaagccgaagagatttcatccgctgtattttctttattatttgggggtgtcgttcattgcaaacgggatcatcttcggtcttttgcagccgtcaggccaatctctgttttctaattcagccttttatatctttgcggttttaacagccgtcgtctattgggtatgggattccgtattgctgcaaagacaaaatccggctacagaagcgtaatcagcagacagccggctgaagggagagcggcgcaaaagaaaacggcggccatctttaaacgggcgcgccgtccttcttctgtttcagaatgataattggcccgctgctccgctccgcttacggccagcccggaaacgatgaccgctgcgacgataagaacagccgtaacggcgccgagaatgatgtcaaagccaaacggcaggacaaatccagccgcataagctgcggcggcgagtatacatccgaaggcgaacgcttttttcaaggcggatgcccctttcattttctttccattgtaacaaaagcccgccgtgtgcgtcaccggcgggcttttttcatgatgtgatgaccgcggatacggttctgtcttttccgttgatgtcctgtacgacttccacttccgcattcggaaaggaatgacggaacaggtctttcacggcttttccctgattatatccgatttcaaagacgacaagcgctttatctttcatgacaagaggcagctcctccataaaccgcttgtagaatttcaaaccgtcaccgccgtccgtaagtgcatgaagcggctcatggaaacggacgatatccgacaaatccgccatttcttcttcagaaatatacggcggattggaaacaataatatccgcttttattcctgatgaaataaaaggagttaacagatctccctgcaaaaagcggacgtccgctccgaggttttgcgcatttctttccgccacctgaagcgcttcttttgaaatgtccgaagccgatactgaaaaatgtccgcattcaagcgcgagcgtcaccgcaatggctccgctccccgtaccgatatcaatgacgttcaggcgttctccctcagaaaacacccgcttctgtctgtccagcagatgaaagacgacttcttccgtttccggacgcggaatgagaacatcgtcattcacaaagaattctctgccgtaaaactgttctttcccgataatatattgaatcggaacgccttctttatgcatttccacatgccgtctgaatcggtaaagctcgtcctcgccgacgggctcctgcagacttgcgagaagcttgctccgatccattccggtatcatttaacagcagcagctcggccgcgtttttttctcttcccgcttcggttaaataagaagaagcccagcttagggcttcaaaaacggtcttcatcttaattttccgcctgctggagcttgcttgactggtcttctacgattaacgcttcaaccacttcatcaagcttgccttccaggatttgatccagcttttgaatcgtcaggccgatacggtgatccgtcacacggttttgcgggaaattgtatgtgcggatacgctcggaacggtcgcctgatccgacggctgatttacgggtctgatcatattcagcctgagcttcctgctggaatttgtcatagattctggcgcggagcaccttcatcgctttttctttatttttaatctgagatttttcatcctgacaggatacgacgacaccggtcggtaaatgcgtcaggcgtacggccgacatcgtcgtatttacgctttgtccgcccggtccgcttgatgcgaatgtatcgacgcggatgtctttttcgtggatgtccacttctacttcttccgcttcaggaagacacgccaccgtcgccgtggatgtatgaatacggccgcctgattccgtttccggcacacgctgtacgcggtgcgcgccattttcatacttcagcttggagtatgcgccttttcccgtaatcataaagatgatttctttgtaaccgcccgttccggtcacgtttgcttccatgacttcagtcttccagccttggatttcagcgtaacgggagtacattctgtagagatttcccgcaaacagcgcggcttcttctcctcccgctgctccgcggatctccatgattacgtttttgtcatcgttcgggtctttcgggatgaggagcactttcaaacgctctgataaggtttccgtctctccctgcagttcggagatttcttccttcaccatttctctcatatcggcatcaagcttttcctcaagcatcgctttcgcatcggcaagctgttctgatgcgtctctgtattgtctatagacttcaacggtttcttgtatatcagattgctctttcgaatattctctaagctttttcggatcgttgaccacttccggatcacttaaaagctcatttaatttttcgtatcgttgttcaattgactgtaaacggtctaacacggtcttcacctctgttttcctgtgcgtaacattctcattatagtatagggcttatcaccagtcaaaagcaattcgcctctgttatactgaagcaaaaaaggaggggcggatatgctgaaatccatccaccatatagcaatcatatgctctgattatgaaaagtcgaaagctttttacaccgagatactcggtttcggcattataaaagaaacataccgaaaggaacgggaatcttataaactcgatctggcgctggacggcgcgtatgcgattgaattgttttcctttcccgatccgcccgaacggccgaccagaccggaagccgcgggtctccggcatctcgccttcaccgtaaacgatcttgaagcagccgtcagggagttaaagaaaaagggcgtcggcacagaaccgatcagaaccgatccgctgacggggaaacggtttacctttttcttcgatcccgacaagcttccgcttgaattgtatgaagcgtaacgttttttgaagaaatgccgctttctttggcgaattccttcttgttttgtctaacatgaagggaacgccgcctcatggtcgaatacctagcaaaaaggaggtatgtgatcatgaatacaaacatggccgcgaaagagctcggcgtctccgcaaaaacggtgcaaaggtgggtcaagcagctgaatcttccggctgaacggaatgagctcggacattattcctttacacctgaggatcttgatgtgctgaaatcggtcaaacggcaaatttctgaaggcactgcccttctggacgttcaagtgccccggcagccgaaaaaacggacgggcttcattttgcagcgtccgaaaatcaatggcggcgctgaacaaaggttggcagagctggagcgcaaactggacattctcacgaaagagaaacaggatgagaaccatctgctttcaaggatagaggagcttgaacgccagctgaaacaaaaggcggatgaaggggtgtcttatcagcttcttcagcacagacgggaaattgacgacctcaataccgaattgcagacattggcctcccgcatccaggaacttgcccagacagctcccctctcagaaacagccgcttcttcagaacataagaaacccagaaaaaaaacgagattttcgccttttaaatttcaattctaatcaaaaaagctccctgaaacagggagcttttcattatgcagtcagcgcaatgatgatcggcagtgagataagagataaaatcgcactgatcacgaacgcggacgcagtttcttcctcttgtttttcgaaacgtgtggcaatcatcgccgctaccgcagatccagggaatgcgacgagcaataccgctttagtgatctggtcagccggaagtccgactgcaagagcgatcaagtacatcagcgcaggctgaacggcaacttttaacaaagcgataccgaaagccggcagactgagcttgatgttgcggataccgacagttacaccgacggcaaagagtgcaacacctgatgttgtgcttccgagctgatcaagcattttttcacccaagccagggagtgttacaccgcagagtaccaggatgatactgataagcggtgcagccgcaagcggttcggaaagaccgtgaagaatagacttaccagtcattttccagaagttctcgttttcgctgtcttgtttcttagatgactcaccgactgtagcgataatgatcgcaagcgggtcaaggatggcgttaaccacgatacccgtaacggcgataggaatcgctacttcgtttgctccgaataagcttccgagtaccggaatacccataaatgcaaatgtcggctgtgcagagtttaaagaaaatacagatgaattcgttaaatcatacttgaagataaatttgcaaaccaacaaaatgacgataaagaatccgacaatcccaatgatcaaagcgatcattaaaggaacctgtgataaaaacgcacttcttgaagtggttaaaatacttgcgataaaatgcgccggaagcgcgtacttcgtaactaaggtgcttaccccttttgctgacttcgcgtcataacttccgaagcgacctgcgaaccatcccagcacgatcacgaaaaagatcggcgccaggaggattaaaatatctaagaagctcaaaatattctcctccaaatccttaatgtccgtatactttagcctttacataaaagctttccctcggactgtaaaattaatcgtaaaaattatttagcgataacttgtttatattgcggtttccacattgcatcaagaacggcttgttctacattctcaggaatgcggtttgccacgccttctttaatggcagtttccgctacggcgatcgcaactttaattgaaacttcttgtaagtcgctcatgctcggcagaaggcctgcacccggtgtttcaaaatcaacgctttctgcgattgcgtcagcagttgccgcaaacattgcaggagtaatcactttcgcttctacaacgattgaaccgagaccaagtccagggaacgcgaatgcgttgttagattgtccgatttcatgagaaacgccattgtactctacattgtcaaacgggcttcctgtcgccacaagcactttgccgtcagtccatttgaatagatcgctaggaacggcttcagcaagcggtgtcgggttagacatcggcatgatgaccggacgctcaacgtgttttgccatttctttgacgatttcttcactgaacgcgccgctttggcctgatgtaccgattaagattgtcggtttcgcttgacggatcacttcaatgaaaggaatttgtccgttttcatcgcgtttccaatctttaatttcttcagctgtgcgcaggtacggctcttggaaatcaagaatgttttccataccttcaattaacaagcctctgtagtccattgtgtagaacgctttgttggcttcttcttcagaaagaccggcaagcaccatagtgtcgcggatttggtcagcgattccgattccggcagatcccgcaccgaagacaaccacacgctggtctttaatagacgcgcctgttttcttcatagccgcaagcacacctgcaagcgtaatcgcgcctgttccttgaatgtcatcgttgaatgtaagaatttcatgattgtatttcttcatgatattgcgcgcgtttttgtttccaaggtcttcccagtgaagaagagctttagggaaatatttaagcgcagcttttacataagcgtcaatgaaagcttcataacgttcgccttggatacgttcatggcggttaccgatgtataaaggatcgttcagaagtttttcgttgttcgtaccgacgtcaagaacgacaggaataacacggcttgggtcaataccggcagcagctgtgtatacggctaatttaccgatggcgatgttgataccgcctacaccccagtcaccgattccgaggatgctttctgagtctgtcgcaacgatcagatcaatatctccggcagtggcatgaaggttttcaaatgcctcttcgattccttctacattgtcgatagaaaggtaaatcccttgaggtcttctgtactcatggctgtattcttgaatcgcttcaccgacagtcggtgtgtaaacaaccggcagcatttcacgaagatggttttgaagcaatttaaagaaaagaacttcgttacggttttgcaaatcattcaaatacacgttttggcgaaggcggtccggctgagcttgaaactgctcgtatgcgcgttttgcctgctcatcaagagacagaatggtcggaggaagcagcccgtctaatccaaggctttttctttcttctgctgaaaacgcaacacctttatttaaagtagggatagatagaacttcttttcctcttaaagtagtttctaagttgccttccttcgttactttaatattattcaagaaaatctccttctttcttcaaatagttaacaaagttaagtaattacccattttggctagtgtgatcgcgatctgctatatctttttttgacaattattcgaacaatgtctcataactatttacattacttagtcattttatgcctgtaaaaatgaaaattcaagagatgaaaattacttaattttttcatactcttttttaagttaattaactacaatttttgaaaaaccgtcaaaaaaacaccggattttttaccgatgttttcatgaaaagggttatttatcagtctgttttttcagcacttcgtggtgatgtctgcatctcgcttcgtatgactccgacgcgccgactaaaatgaccggatcatcataggaagcgggcttcccgtcaatcaaacgctgcgtacggcttgccggcgacccgcaaacggagcagaccgcctgcagcttcgtcactgattcggcaaccgccatcagattcggcaccacaccgaacggctctccccggaaatccatatcaagtccggccgcgatgacacgatagcctttatccgcaagcaaggataaatcgccgatgattgattcgccgaaaaactgcacttcatctaccgcgatgacgtccgtgctttcactgatatgatcccatatttcagccgaagacgagatgacgtggcttgtcatggatgtgccgttgtgagaaacgacagcctcctcactgtagcgattatcaatggcaggtttgaacaccttgacctcctgcttcgcatatgtcgctcttttcactctgcggatcagctcttctgatttcccagagaacatgctgccgcatatcagctcaagccatccgctttgcttcattatgtacataggctatccgctcccctttttttcctgtttatggacataaaaaacaggcaagaagcaattcttgcctgcctgtaaaatctattattacttaagaccgtattttttgttaaagcgatcaacacgaccatcagcagaagcgaatttttgacgtccagtgtagaatgggtggcattcagagcaaatctcaacgcgtacctcttcttttactgagcctgtttcaaattcatttccgcaagcgcatttaactgttgcttttttgaaattaggatgaattcctgctttcattgtatccatctccttccgccctgaatcccgtgtggaaacagagttattattccggagcgaatccggaacgcatatgagagaattatatcagtcatttactgcatttgcaaatacattttttatcagcggcgggctgatgatgaaaggtttgcctgcttccattcttggttgatcagatcgaagaattcctgattcgtttttgtttttttcatttttctcataaacttctctgcgaagtccggagaatcagacatcgatttgcggatcgcccatagacggtcaagatgctctttcggcacgagcagctcttccttccgcgtgccggagcggcggatatcgatcgccgggaaaatccgtctttccgcaagagaacggtcaaggtgaagctccatgttgcccgttcctttaaactcttcatagatgacgtcatccatccgggagcccgtgtctacgagcgccgtcgccaaaatggtcaggctgccgccctcttcaatgtttctcgcggcaccgaaaaagcgcttcggacgatggaacgcagccgggtcaatcccgccggaaagcgtacgtccgcttggcgggataacgaggttgtaggcccgtgccaggcgggtaatgctgtccatcagaatgataacgtcttttttgtgttcaacgagacgcatcgcccgttcaagcacaagctccgctaccttaatgtgattttccggcacttcatcgaacgtcgagctgacgacatcgcccgctacggaacgttcaatatccgttacttcttccggtctttcatcaattaagagcacgatcaattcagcgtcaggctgatttgtcgtaatgctgttagcgatttcttttaacagcatggttttaccggctttcggcggcgccacgatcagaccgcgctggccgaaaccgacgggagccatcatatcgagaattcttgttgagagatagttcggtttcgtctcaagcaccatttggcggtccggataaagcggagtcagcgcaggaaaatgaacgcgctctttcgcagattccggatcgtctccatttaccgcttcaacgtgcaaaagtccgtaatagcgttcgttttctttcggcggacgcaccttgccggatactttgtcaccgtttcttaaatcaaagcggcggatctgggaagcagaaatgtagatgtcttctgagcttggcgagtaattaatcggtctgaggaagccgaatccttccgattggatgatttcgagcacgccttccataaacagaagatcctcctgctcggcgttggctttcaggatggcaaagattaattcttttttagtcagtttgctgtagtaggagattttataatgtctggccagttcatatagttcttttaatttcatattttccaaagaggaaatagatacgtctttcataaaaacaccacgcttttcatagtcaatgtattgctgttttcattcaaatcggctgcttcgcatgattccgccaaagcacattcttttataaaacgttcaggaacttctatcggtaacacttccacccatgatcggcgcttttttaaaaaaggaatgtcttaatgagttttgaaggaagcgaggacaaaaacttgagaagatcaatatttatatcgtctgtatgcggtagaatttgaaaatttcccagtactcaaaagaaggaatgacacagaaaaatcgcagcactctttatttttacctcatttcaaaaaattattcaacttaaataatgctttgacatataaatgatagggttgactcttttttgcaaaagaaaagcgggactttccgtcccgcttttctctatttatggccggatcacaagatttggttttttcttcaggctgtgtcttccgtcaacgaatcggaccgttcctgatttcgcccggatgaccaggctttcagtcgtgccgacggagcctttgaactgaacgcctttcagcagctctccgtccgtgacacccgttgcggcaaaaatggcgtcatcccctctcacaaggtcctccatccggagcactttggatacatcaaggcccattcgctcacagcgggcctgctcttccgcactttgcggcagaagcctgccgatgatttcgccgccgagcgcttttaacgcaacggcagacagcacgccttcaggagccccgcctgaaccgaagagaatgtctactcccgtatggtcaaaggccgtattgatggcgcccgcgacatcaccgtcgttgatcagtttgattctggcgcccgcctcacgcaattcagagatgattttttcgtgtctgtcacgatttaaaatggttgccacgacatcttcaatgtctttgtttttcgctttcgcaacggcttttaagttatcaatgacaggcgcttcgatatcgatgcagcctaccgcttcgggaccgaccgcgattttttccatatacatatccggggcgttcagcaatgttccatggtcggcgaccgcgatcaccgtcagcgcattccagccgccgctcgctacgatgtttgtgccttcaagaggatcgacggcgacatcgacgcgcgggccgtatccgtttccaagcttttcgccgatgtaaagcatcggcgcttcatccatctcgccttccccgatcacgaccgtgcctttcatcggcaccgtgtcaaacacgtcacgcattgcgcttgtcgccgcatcatcagcttcatcttttttcccgcggcccatccatctggcagatgctaaagccgccgcttcagtgactcgaaccaattccatcgataagcttctttccatttcaacacgatctcctctcaaaagtccgcatttctatgaattttggagctgttctatctcttcgtccgtcagcctttgccgccagattgtggcgcccagaccttcgagttttttctcaagattgctgtagccgcggtctaaatgctcaagaccggtaatttcggttacgccgtcagccatgagcccggcgacgaccagacaagcgcctgcacgcagatcgctcgcctttacttttgcgccctgaagctcggccggaccggtgataatggccgacctgccttccactttcatattggccccatccgtctcagctcatcaatatgtttaaatcgggccgagtagatggtgtcggttacgacgctcgtgccgctggctctcgttaacagagatgtcatcggctgctgaagatcagtcgggaatcccgggtaaacaagcgttttcacgtcgaccggttttatctgcttctgcccgccgagcataagaagctgatcgtcactcgtctcaatgtaaaaacccatttccctgagcttcgccgttaaagactccaggtgagtcggtatgacattatcaataatgacttctttccccatcgcggcgccggcgatcataaaggtgcccgcctcaattctgtccggaatgatcgtatgcctgcatccgtgcagctcttttacgccgtcgattctgattacattggttcccgcacctttgatctttgcgcccatgctggtgagcaatgtggcaacatcaataatctcaggttccttggcggcgttttctatcacggttttaccttcagccagtacagcggcaagcatgatattaatcgtcgctccgacgctgacgacatctaaataaatccgtgcgcctctcagcctttcggcgcgcagataaatcgcgccttgttcattggtgacttccgctccaagcgcctcaaaccctttgatatgctggtcaatcggccgcggaccgagatggcatccgcccggcagtccgatgaccgcctgtttgaagcggccgagcatcgcgcccattaagtaataggaagcgcggagttttttcactttgccgttgggaagcggcatgctgatcatcggggaagggtcaacgaccatttctcctttttcaaaatggacgtttccgccgatttctttcagcaggtcacgcagcgtttcaatatctgagatctccggaagcccttcgatcgttacttcggaatttgccagaatggttgcgggtatcaatgcgacggcgctgtttttcgcaccgctgatatgtacggttccgtttaacggatcgccgccggcaatattcaacttttccatgatagtctccttccataagaagatagctgcggagcgtaaataaaatggcattttattctgtctctgcaaataaagctcttgtccaaaatgtagccaattcgaagagaaagaatacaaggacattataaaataacaggaagaaaatagcgaagctttgcggggcatttttaacacaggatgcacagaggcccgccgggttcatattccggggaaacacactcttcactttgatactgaaggcccgctgccaaacaggaaaacataagggtgcggcaaacggatgcaaccggtttgccgcccttttcccccttatttattccagtcagccaagaattgctcgatgcctttatccgttaacggatgtttcgtcagctggtgaatgactttcagcggcatcgtaccgatatgcgcaccgcgtaaagcggcttcagtcacgtgctgcgcatgacggatggaagctgcgatgatttgagtatcaatgtcatgaatgtcaaaaatctgtcttatttctgaaatcagttcaagaccgttatggccgatgtcatccagacggcctaagaacggagatacataagtcgccccggctcttgccgccaaaagcgcctggttggcgctgaaaatgagcgttacgtttgttttaatgttcaggtcgctcagcgcttttacggcttttaacccttcagacgtcatcgggattttcaccgtaatattcggcgcgattttcgcaagttctttaccttcttcaatcatttcttcagcattcagggaaatgacttccgcgcttactgatccgctcacgacttccgtaatctcacgaagtctgtcatggaaagacacgtcagcttctttcgccactaaactagggtttgtcgtaactccggcaagaacgccaagttcataagcttctttaatctcgtcaatgtttgctgtatcaatgaaaaataacataaggaaagcctccccagtaataaattttcagaactgtaaaacatgattgcgctttctaaaggtaagacataaaaccgcctgtcaatgctgtcaggcggtttatggatgttacattggattaagcttggtttgaagaaccgaactcacgcattttgccgataaccgtttctttgatcgcttcacgagcaggtccaagatatttacgaggatcgtattcgttcggcttagctgccaatgtttcgcggacagcttttgcagaagaaatttggttttcagtgtttacgttgattttagccgtaccaagtgagattgattttttaatgtcggcagtcggaattcctgtaccgccgtgaagtactaacggaaggccggttgatttgccgatatcttccatttctttgaaaccgaggttcggttcgcctttgtaagggccgtgaacagaacccagtgcaggtgcaaggcagtcgatgccagtgcgctctacaagttcttgacactctttagggtcagcatagattacgccttcagcgatcacgtcatcttcctgtccgcctacagttccaagctcagcttcaactgaaacgccgtggaaatgagcaagctcaaccactttagctgtagttgctacgttttcctcaaacggatggtgagatgcgtcgatcattacagaagtgaaacctgcatgaatcgctttcgcacaagattcaaagcttgaaccgtggtctaagtgaatcgcgacaggaactgtcactttgtattcttccataagagctttaaccatggcaaccactgttttgaagccgcccatgtagcgtcccgcgccttctgaaacaccaagaataaccggggatttttcctcttctgctgcttgtaaaatagcttgagtgaactcaaggttatttaagttaaattgtccaacagcatatcctttttctttagctgtattcaacatttccgtcattgaaactaaaggcatgtcgaaagtcctccttatgtagcctgatttgcttcttctcgaaaaaagctttccacctatagcatgaccataaaaacctgtcatatgtaaaacaacagatcgctttttctccatctctaggataccaacttttcgacaaatcggcaacacaatgacataattgtttctaattttattaattcgattttagaggtaaatattttttcaccgcgtctctgatctcatcaatgtcaaaaggtttcgcaaaatgagtcagcgctccgagctcttttgattccttaatcatatcgagttctccgtaagcggtcatgataatgacgcggatggattcgtcgatcatcttcatgcgcttgagaatttcgattccgtccatgccggggattttcatatctaaaagcacgagatcgggccgttctttcgttacgatgtccagcgcctgtatgccgttggcggcctgaaacgtctggtacccttctttatggaacacttcattgagcaatatgcgtataccgtattggtcatctacgattaaaatcttttcattcatcattttacaccccaatattatcattttcgtcaaaaggaagcagttgtttatgtattctgtttgattttcacatttcctttaattataatagtctactttccgacattttctgagcattttctcttttgttgtatactgttcttgtatgtgtaaaggaggtttcactcatgttaaagatatttacgacgcagcttgcaggcattttttcccgcattcaggataaggagtccgatgcaatagaagacggcgcgcgcctgctggcgcaggcagccgtcagcggtcataccatttatttatacggcgcaaatgagatgcagggcattttgtgcgaggcggaactcggctcagaaccgatgccttctgtcaaagcgtttccggatacagctgattcgattacagaaagcgacagggtgctgatgttttgttcaggtccgggcacggctgaagaacaggcgctggctcaaaagctttatgaaaaaggggtcggcctcgtttgcgtatctcctgtcatcaaagatcaaaccgggattgaggaattttgtgatgttcatattgacagcaaattaaaaatgccgcttctgcccgatgaagacgggacaagatacggctttccttcattaatgacaggcctgtatgtctatcacgcgctgtcctttacgttaaaggaaatgatgcaggaatatgcctgatgcagaaaaaagacttgccgcttttaaaggaggcaagtctttttttattacttctgttctgcagcttgtacggaagcgccgataaagtctttgaataaaggctgaggtcttgtcggtcttgatttgaactcagggtggaactggcaagcgacataccaaggatggtctttcagctcgatgatttccacaagacggccgtcagggcttgttcctgagaacacaaaaccgttctcttccatttgctgtctgtattcgttgttgaattcataacggtggcggtggcgttcgtataccacttcatccgaatacgcttcgaaggctttcgtgtcttcctgaagcttacaagggtacagtccgagacgaagcgttcctccaagatcctcgacatctttttgttctggcagaaggtcgatgatcggataaggagtggacggatcgatctccgcagagtgagccccttccagacctaatacgtttcgcgcatattcaatggatgcaatctgcatcccgaggcagatgccgaagaacggaattttattctcacgcgcatacttggcggcgatgattttcccttctacgccgcggtccccgaaaccgccgggcacgatgattccgtctgtgccgccagtcagctcttgaatattgctttctgtcacttcttcggcgttaatccatttgatcttcacatcagcgtcaaacgcatagcccgcgtggcgcagtgattcaacgactgaaatgtaagcgtcctgaagctcgacgtatttaccgacaaggctgattgtaatggttttagacaagtttttcactttcgtgacaaggtctttccattccgtcatatccgggtctttgcattctaatttcatatgatcgcagacaagcttatcgagtccctgctcctgaaggttaagcgggatggagtaaaggttgtccgcatcttcacactcgatgaccgctttcgtgtcaatatcgcagaagagcgcaattttatctttcatatcttgagaaatcggcatttccgtgcgcacaacgatgatattaggctgaataccgaggcttctcagctcttttacgctgtgctgcgtcggttttgttttcagctcgcccgccgctttgatgtacggaacaagcgtacagtgaatgtacatcacgttttcatggccgatgtcgcttttcatttgacggatggcttcaaggaacggaagagattcgatgtctcccactgttccgccgatctcagtaatgactacatctgcgtttgtttctttgcctgcacggtacacacggtctttcagttcatttgtgatgtgcggaatgacctgaaccgttccgccgaggtagtccccgcggcgctcttttttcaatacggcagaatagattttacctgtcgtcacgttgctgaatctgttcagattaatgtcaatgaaccgctcataatgccctaagtcaaggtcagtctcagcgccgtcatcggtaacgaatacctcaccgtgctggtacgggctcatcgttcccgggtcaacgttgatataagggtcaaatttttggatggtgacgctcatgcctctgtttttcaaaaggcggccaagtgatgctgccacaattccttttccgagtgatgatacaactcccccggttacaaaaatatatttcgtcatttcgtttgctcctctcttcggtctgcgctacattccttaaaatgtgccgttttatagaaaatcatttcactaaaaacaaatgatgtgtaaaagaatttgggagatgaaaataagaaagctccctttcaatttcttgaaagggagcgtagcactcttatgaattctcttctttttgaagagcccaaaatacatactacatagttcgacaatgaaagtcaagatcgttttgctgatataaaatcagtctttgcgatcctcttcctcatcatcataatcttcctcatcttcttcaatcatctcatcttcaatctcaagctcgtcgtcatcttcttcatcgatatcttcgtcgtcaaagctgtctgcgtcaaggtcaatatcttcttccatttcatcgagatcgatgtcatcttcatcaacttcctcgaattcatcaaggtcgagatcttcctcaacggcttttttcgcttttttctttttcgcttttacagtcggctgtgtttcttcgtccagctgatcgtacggataccagctgcggagcccccatgtctgatctgacagagcaataaagcggccgtcaatgttgaggtctgtataaaattgggcgatacggtcgcccagttcctctttcgtaacaccgagtaaggagatcatttcattcagcagctcctggaacggaaccggttttttatgttctgagaaaatttcgtgagcgatttcaactaaagccatctgcttcagctgttcctgagaatattgtttgatactcaaggtcggacactccctttctattacttatatgtatctgtttctatcctataataagaacgaatttgtattgttttgttcataaaccatacctctcattataaacaaattaaaacagaatatgctaccctaaacagcgtaatttaagaaattttagagccgccccttcataaatcggctgatgtgcgaaaacaaagccgccggcatatgcgccggcggcccgcttctttctataaagactcttgtttttcggcgccgaatacagacatggcgagcaattcactgacatcataagtgccgatcgcgtcttcggcttctttcgctttcgtcccgtcaccgagcatggtcagacagtaaggacatccggagctgatgaccgtcggactgacagaaagcgcctgctcagtccgggccgtgttgatcctcgctcccgtttcttcttccatccacatgagccctcccccggcgccgcagcacatcccgttttcgcggctgcgctccatttccttcaattgaacgcccggaatggcttttaagatcgctctcggcggctcatacacttcgttgtatcttcctaaatagcacgagtcatggaaggtaatcgtttcattgaccgggtgaagcggttttagtttcccctgtgacacaagctcggctaataattcagtatgatgatagacttcggcccggaatccgaaatcagggtattcatttttgaacatattataggcgtgcggatcaattgtgacgatttttttgattccgtgtttttcaaattcgccgatgttgtgttccgccagctcttggaacagaaactcgttgcccaaacggcgcggcgtatcgcctgagtttttttccttattgccgagaatcgcaaaggatacgcccgcttcattgagcagctttgcaaatgaaacggcaatcttttggctcctgttgtcgtaggaacccattgagccgacccaaaacaaatagtcgaactctttgtcttgttttttcatttctttcactgtcggaatctctgtatcagcctgctcccgccagttctcccgctctttccggtttaagccccacgggtttccctgtctttcaatgcttgtcatggcccgctgcgcgtcgctgtccatcttcccttccgtaagcacaagatagcggcgcagatcgataattttatcaacgtgttcattcatgaccggacattgatcttcacagttgcggcaagtggtgcacgcccaaatctcctcttccgtgatgacctcgccgattaagctcgggttgtaatcaatggctgccgccgcttcacgcgatcctccccctgaggaagccgcggcgagctgattcgccttcgtgtgctgaaaaacgggcgcgggcacccacggagattttgatgtcacggcagcgcctttttccgtcaaatggtctctgagctttaaaatgaggtccatcggcgagagcatcttgcccgtaccggaggccggacacatatttgtacagcggccgcattcgacgcaggcgtaaaggtcgacaagctgagagcggcggaagtcttcaatctttccgacgccgtagctttctttcgtctcatcggtaaaatcgattttttccagctttccttttgaatccagcctgctgaggaacacattcgccggacccgcaattaagtgcgcatgctttgattgcggcacgtacactaaaaagctgagcaaaaacaacagatgaagccaccatgaaacataaaacacggcggcggccgccggcgctgaaagaccgccgagcacaaacgcaatggaggaagcgatcggttccgtccaagacagagaatgatcgtgccataaaaggttcatggcgttcccgagcagcaccgtcaccatcagtccgccgataaacagcaggacaagccccgctttaaacccgcgtttcaatctgacgagcttttcaatgtagcgccggtaaaacgcccagactacggcgattaaaatcagaaacgtgacgatttcctgaaaaaaggtaaatgccggataaagcgggccgaacggcagatgccggtcaggaagcagccctttcagaataaaatcaattgcgccgaactgaacgagtataaaaccgtaaaaaaacagaacgtggatgattccgctctttttatctttcagcaattttttctgtccgaacacattcacccatatcttctgaagacgttctttcaggcgtttatcaaattcttccctttggccgagcttaatataagcgatcctcgttctgatcaggtaaacgaataaataaacggcgtaagcggttacagctgaaaacagcagcgcgtttaccatgagaaatgcgttcatcttgtctccccctttgttctgattcccctcttcattgtcatatctttactttatcataaataatgaatgagtgttcagtcaataattaaattcacattctcagggcacactacggatacttcggaaaggagcgtcggtatgaaggtcatttttgtgttgcttgtcatttttatcatattgatcgcacttatgctgcttgatatgctgcttggccgggcggcgtacaaaaaacaggcgtatgagcccgtttttgaccccaaaaaaagtgatatcacactcattcactgcggcagcgagcttgtgcagcagatgacggctgatatccgccaagccgtctcttctattcatatgatgttttttattatgaagaacgaccaagtcagccatgagatgtttgatttattgaaagaaaaggcccgggccggcgtctccgtatatctgctgctcgattgggcgggcagccgccaagtgaaaaagccttccattcaaacgatgaaaaaagccggcgttcacgttcattttctaaataaaccggcatttccctttctttttttcaggctgcaaaaacggaatcaccggaaagtgaccgtcattgacggcaaaatcggctatgtgggcggctttaatatcgctgaagagtacctcggaaaaaaagcgaagttcggaaactgggaggattatcacctgcggatgaccggcgaaggcacggcagatcttcagactctttttgtaagcgacctgaaacgaaacaccggaaaaacacccgaatcacccggggtttatccggcattatccgaagggaatatctctcataggacatatgcatctgacggtttttcgcttgaatcgcattatgaaaactgcatccgtaaggcggagaaaaaaatcatcatcggcacgccttattatgtaccgagcaaaaagcttcaggaagcgcttatttcagcctgccgaaaaggcgtcaaagtcatcttgatcgttccgatgaaatcagatcacccgctcgttcgggaaacagcttttacctattatcccgagctcctgaaggccggctgcctcatctatcggtattatcaaggcttttatcatgttaaagccttcattatagatgaccgcatcagcattatcggcacgccgaattttgataaacggagcctgttctggaatgaagaggtaaatgtcatcattcatgatgaggcctttacaaaggaagtgctttcaaccataaagcaggacatcgaaaaatccgagcttctcacattagaaaaagtgaaacagcgctccgtcagacagcttcctgcagaatggctgggaaaggccatatcttactttttataaaggagaaaccatatgctgttcagattcggattcgtcgcaaacgccatgtgcctttgggacgcgtcccccgccaaaaccttaacatatgcgcgctataccaagctttcccgcagtgagcggaaagacgctctgctttctgtgacgaaagcaaatcttaccaatacgctgcgcaccctccactatgtggtcggccacggcatccctttgtacaggttctcaagctcaattgtgccgctcgccacgcacccggatgtactgtgggattttgtcacgccgtttcgccaggagtttcgtgagatcggcgggctggtcagaaaatatgacctcagaacgagctttcatccgaaccaattcacgctttttacaagcccgaaacgggagattaccgcaaatgcggtcaaggatatggcctatcattatgacatgctggacgcaatgggcatcgcggaccgttccgtcatcaacatccatgtcggaggcgcttacggtgacaaacaaagcgcgcttggccgtttccgcgtgaatctgaaagaacttcccgaagtcatcaaacagcggatgactttagaaaacgatgataaaacatatacgtccgaggaaacactcagtgtatgtgagcaagaaggcattccgtttgtgtttgattatcaccatttttacgccaatccggccgatgacgctgatttagatgacattcttccgcggatgatcaaaacatggcagcggatcggcttaaagccgaaggtccatctctcctcgccaaaatcagaatcagccgtacgcagtcatgcggactatgtggacgcgaattttattctgccggtgctggagcggttcagacaatgggatgcgggcatcgattttatgattgaggcgaaagagaaagaccgggcgctgctccggctcgtcgaagaattaagcgccatccgcggagttaaacgcctggcgggcggagtgctgaggtggaaggcataaccaggtttatcacccgttcatatggggaatttccgaaataacagaccatcagacggaggagaaaacacatgaaaaacattacatctttgaaaatagccgctaagaagttcactttaagaaacatgcttcagctttatcagctttgccacacgggaggccacgagctgtatatctactctaaaaaaacaatgtgcaaaatcaaagatatcattgagctggaaacgttcagaatggctcataaagaacaagaatatttaattgtagtggaaggaaagaaagcggtgcagcttgttgaccgtttcaaacatatcatcgaacctgcgcaaaaagaagcccattaaatacggactacataaaaaaaaggatagacaggaggctgcccggcccccgctcgtctatcctttttccattattcatgtatcagctcgccgaattgggcctgatggagtctctggtatatgccgccggatgccagcagttccttatgatgaccttgttcagcgatgccttctttcgtgacgacgacgatcctgtccgcatccttaatcgtagccagccgatgggcgatcacaagcgtcgtgcgtccttcagacagctcttgcagcgatttttgaatggcggcttccgtttctgtatcgagggctgatgtagcctcgtctaaaattaagatcgacgggtttttcaaaaacattctggcgatggaaagccgctgcttctgcccgcctgacagcttcacgccgcgctcgccgatcaccgtgtttaaaccgtcgggatacccgtttaccagctcctctaaatgcgcctggcggacggcctgccggatttcttcctcagacgcatcgagccgcccgtacgcaatgttttcccgcaatgtgccggaaaacagaaagacatcctgctggacgacgccgatttgtccgcgcaatgatgacagcgtcatgtccttaatatcaattccatcgatggaaatcacgccttcagacggatcataaaaacgcggcagcagacttgtcagcgttgattttccggctcccgaaggcccaacgaatgcgactgtctcccctgcatgaatggacaaattgattcccgacagaaccgggctgttttcttcgtaaccgaatgacacaccatcataacggatattcccttttaaaccggacacatgtctcgcgttcggggcgtccttgatatcaggctccgtttccattatttctataaagcttttaaaaccggctatgcctctcggatacagctcaataattgcgttgattttatcaatcggacggaacagaacgttcgtcagcagcacaaaagcgacgaattccccgtaagataacgatccgcggatcacgaaccatgtcccgcacaacaggacgaacagcgtgacgaatcttgtcagcatgtaactgatcgagccgtttttcgccatgattttatatgacgtcagctttgttttgcggaaacgctgattgttcacgtcaaaccgctgcgtttcaaacgcttcattgctgaaagcctgaacaagacggatgccgccgatattgttttcgaccctcgcgctgaagtctccgacgtctttgttcagttttgtaaacgcagaggtcatttttttattgaaatacaaagcaagccaaatgacgaccggcataatgataaaggtcaacagcgcgagctgccagttaatgaacagcatcacaccgaacgcgcccaaaatcgtcatgaccgcgataaacaggtcttcaggcccgtggtgggcggtttctccgatatacatcaaatcattggtgagcttggacattaaactgcccgttttgttgttatcgtaaaatttgaacgaaagcttttgcagatggtcaaaaagctttttacgcatatcggtttcaatgttaatgccgagcatatggccccaatacgtcacaacatactgaagcgccgagctgagggcgtagactccgaataaagcagcggaagtcaaaataatcagacgccaatcccgcccgggagcaatgtatcgataaagtaattaacaatcagaggaaaactcagctccatcaatccgccggcgatggcagaaaagaagtcgagaaaaaacagcttcttgtacggtttataataagaaaaaaattgtcgcagcacgtttccgtcctccttgtgcctcgttcctaatgataatatttctcaattatactatacacaaggagttttaaaagcgttttttataaaacgccggaaaataaccgcgcgaaggattccttcgttctttcccataatgtgcgcttatagaaacggacggggctgattttctcagactctctcatatcctccagataatgcgcttcaagatctttgatcgccttttgatctgtaaaaaagacattgacctcaaagttcagctgaaagcttctcatgtccatgttcgccgtcccgacagaggcgaggtttccgtcagtgatgagcaccttttgatgcataaagcctttttgataggaatagacttcgattccttcgcgaagaagctcggggaaatacgatctcgtcgcgtactgggttaaaaatccgtcattggtttccggcaccatgactcgcacccggacgcctctggcagcagcctcctttagcgctgtgcggatcggctcattcggcacgaaataaggcgtcgcgatccatacagatgattcggccgccgctatcatggcataatacagatcgctcatccgctccttcatatcggggcccgtcggaacgacttgatagacgccgccgctttctgcagggaccgggcggctgtatgctttctgatcaatcagcacctcatccgaaacgtattcccaatcaagcataaaaatgctgtggagcgtctgaacgatttctccttcgactttcatatgggtgtcccgccaaaaaccgacactttggtctttgccgatatactccttgccgacattcagcccgccgacaaaaccggttttcccgtcaacgatgacgatcttgcggtgatttctgaaattgaacttttggttgaaaaaaccgtatttcagcggcagaaacgggacgatgttcacgcccgcgcgtttcagttttttaatgtcttttccggccagcttcaggctgccggccgcgtcgaacaaaaaccgcacttccacgccttgacgcgctttttccatcataatgtccatcatcttgtgcccaagcatgtctgatttgaacatgtaatactcaatatgtataaatgatgctgccgaccggagcgcttcaaacagctccggaaatgtttcatccccgtttttgagcaccttcagcctgctttttgtattgatattcatatgagacgccttgattgaatattgaaagaaacgcttctgatttcctttcagcccggacagatcgggcgtctgttccatatcaaatatcgttctcagcttttcccggttgtatgtccgtttcgacctgaacagcttgcctttttcataaagctggccggaaaaaaggtaaaataagtacccggcgatcggaaaaaacacaagaatatgaatccataacagcgtgtgctgagaggtgcggttttcaagaattaacgaatagatgctgaacaaaataatgcttgcatagcaaagcaaccctccgtaaaactcaagcctggaaaccggaaaaaaccatatgacatatgctccgataagcatcatatataaaaagcaaaattccagtctccttttcagcatcccgactctctcccatctgatccgatatctctgtataccctctgttttccggcctgtaaacatatgaaaaatcctctccgcacgagcggaaaggattatgatgacacttcctgtgactggccggttgtgatgttctgaagcaatgccggattgagcgagcagctgcctttgattttatttttgaagatgccgatgatcagaccggtgaccgctatcgacactaaggagaagagccctttcagcaatccgacggaaaaaatgccggccagcacgacgccaaaatcgaagaggaaattaacggcacccggattccatccgcagcgcttttgcagaaataaagcgaggatattggcgccgccgagcgatgcctgatgataaaacatgagcgacaggccgaacccgatcagcgccccgccgcaaatcgccccggcaagcggtgaaacagagaccggcggcagccagtgatccgcgccggtaaacagagtcagcacagtgactgcaaaaacggtggatagagtgaatttgattcccattctgatgagagaaaatatataaaacgggatattgatcagaaagaagataatcgcaaatgaggaatgaaacaagtacgacaggcttagtgacagtcccgctgtgccgccggttaatacatgagaatgtctgagtgtcaggacgccggcgcttgtcatcagacaggcggctaaaatgaggaaaatccgcttcattcttcactctccttttgttgatattatttccacataaaacataacaggaatccccgccgcccagccattaccttggcagaaaatatcttatgtttttattttttcaccataaaaaaatccccctcttgcagggggatttttacgtgcgtttccgatagacaacatagctgcgggtcaaatacttgaggggcaggctgaacacgtgaaccaatcttgtaaacggccaaaggataaaaacgacgtaccctatgatgatatgaaacttaaaccatagcgggacactctccatcaaagaagcgtcaggccggaacaaaacaatttccctgaaccacggcccgactgttgccctgtaatcaaatcctttcgagtcaatgttgagaaacgtggccgcaacgcccgacagcatcatgaacagcagcagaataagcgtcaggatatccgatggcgagctggttttgcggattcttttgtcaaacagccttctgtatgtcaggatcactagtccggcacaagccgcgatcccagccggcaggcctgcgccgatcgccattttgtgatacgtatgctctgaaatgcccagtacagtatacacgccttccgggatcagaattcccatgacatgtccgccgacaacgaacagcagtccccagtgaaaaagtgtgctgcccgccgcaagttttttcttttctaacagctcgcttgatttcgccgtccagccaaactggtcatgctgatagcggtaaatatgcccgccgataaagatcgtcaataccatgtacggcataatcccccacaggatctgcccgctcatgcctgagcagccccttcttcagtgctttcacgtacaccgatgctttccagcgcggcctgcagcacgtgcagcagctcagcatagaggctgtcatttttttcgaggcgggaagccagctccctcacattggacaggtatttctcaaacacgcttctcgccgcttcaatctccgcaaccgcggcgaattccagcatcagcggcagataatcaggcaattctttctctgtcggcaggaaaccggattgctggtaggtgttttttaaatgcagcagttcaattccgcgctccctttgctcgcctgagttaaagtaggtgacgtacatattcgtttttttcccgaagtcgaacgtatacacatagtgttcaatcagcgcttgcggagaaaagccggctgccgcctctaaaaagtgcagcagtttctcacggatttgctgaatgccgatttcatggataagagccttccaatcgggaagcccggctctccactcttcatccggataagagagaagaatggaaagagcggagaatgtcatttgccggtctgtggtgttcatcttgttccacctcatttatcaaaagttagaaacaagagccggggccgcctgaaaatgacaagccgcagcttccttgttcagcgtataaatcagacacttcttctcgatggctgctcgggatcacaaagcggtcatcatatttggcgatcgccagcagccgatacatgtcttcaatttgcttttctgttaagccgacactggagatcagtgccgggtcgatggatttattcgtctggactgctctcatatactggcgcatgacagacattttctttaacgttgaccgaatatgatccgtatcaccggctgttaataactgggccaaatagtcaatcggaattctcatttggtcgatagccggaaaaatatcttccgccgtttgccggctgccttttccttcaaagagattcataatcgggctcagcggcggaatgtaccaaaccatcggcagtgtgcggtactcaggatgaagcggcagcgcaatcttccaatcgatgatcattttgtagatcggcgattgctgcgcggcctctatccattcagccgggatgccttgttcttttgccagtttggcaacttcaggatcattcggatcaagaaaaacgtctaattgggaatggtagagatccttttcattttcaatggaggccgcttcctccactttgtccgcgtcgtacagcatgacgccgagatagcggattctgcctacacacgtttcggagcagatggtcggcagccccgcctccaagcgcggaaagcagagtgtgcatttttccgctttgttcgtttgccagttaaaatagacttttttataaggacaggatgagacgcaatatctccatgaacggcatgcgttttgatcaacgagaacgatgccgtcttcctcgcgtttgtacatggcgccggacgggcaggaggacacgcacgccggattgatgcagtgctcacaaatacgcggcagatacatcataaagacttcatcgaattctgttttgatcgattcctccatcttttgcacgtttggatcttcaagacccgtaatgtggccgccagcgagatcatcctcccagttcgggccccattcgatattcataaaatcgcccgtcaaggacgatttcggccgcgccaccggctggtgctttttctgcgggctgtttgttaatgtttcataatcatagttccaaggttcatagtaatcatcaatcgtcggctggttcgggttatagaaaaggcctgcaagccggtttgttttcgggcctgatttcagttcaagctttccttttttcaacgtccagccgcctttatatttgtcctggtcctcccattgcttcgggtagccgataccgggctttgtttcaacattattgaagtacatatattccgcaccggaacggtttgtccacgtgtttttacaggtgacgctgcacgtgtggcagccgatgcatttatccaagttcatgaccattccgatctgcgctttaatcttcaagccaatcgacctccttcagcttgcggatgacgacattcagatcgcgctgattccccgtcggaccgtaatagttaaagccgtagctgagctgtgcgtagcccccgatcatctgggtcggcttgacgtgaatccttgtcgggctgttatgggtgcctccgcggttattcgtcagttttgtgccgggcacgttgatgtggcggtcctgggcatggtgcataaacgccattcctttaggaatccggtgagacaaaaccgctctcgccacgacaacgccgtttcggttgaagcattcaatccaatcgttgtctttgatatccgtgtcctttgcgtcatctttattcatccacacggtcggcccgccccggaacagcgtcagcatcggcagggaatcaaaatacatgctgtggacggaccatttattatgcggcgtcaaataattaagaacgatctctttgccctcttgatcaggccgcttgctcaggaacggacggtgctggaggatcggtttaaatgtcgccatcgtttcaccgaattccatcatcagttcatgatcgacataataggattgtctgccggtcagtgtcctccacgggattaatttttccacattcgtcgtaaacggcgagtacctgcgccctcctttttctgagccggtaaaggccggagacgtgatgaccgttttcggctgggctgtaatttgctcgaacgtaaagcattcttcctcgcgttcttccgccaggtctttcagcttcaggtttgtgatgttttcaagcgattcccatgcttttacggcgacctttccatttgaggtggacgacagggttaaaatcgcttctgccgcctgctttgcttcacttatattcgggcatcctttggcaacgccgtctgaatcggtttctcccagtctctttttgagtgattcatattcatccgcaatcgaccagctcatcccttttgttccgctcggttttaaagccgtatgagggccgagcgcggtcattttatgaaaaatgtgtttgtaatcccgttcagcgacttggatattcggcatcgtttttcccggaatggcttcacattcgcccttgctccagtcattgatttttccgaacggctgggccaattcctgcatcgtgtcgtggaggagcggcgtcgcgactacctctttcaccagctccatatcgacttcttccgccaggtcggaaacggcttttgacagtgctttgaaaatatcccagtctgacctcgattcccacggcgccgagatcgccggagcgaatggatgaatgaacgggtgcatatccgtgctgctgagatcgtgtttttcataccatgtcgctgccggcagcacgatatcggaatacagcgccgtaccggccattcgaaagtcgagattgattaacaagtcgagcttgccttccggcgcctgctcccgccatttgatttcttcagggcggatgctgtcgctgtcgtcattcatcaaaccgttcgtcgtccccagcagatgcttaagaaaatattcatgcccttttcctgagcttgagatcagatttgcccgccatacaaagagattccttgggaaattcacttcattgtccgggtcttcaatcgcgaatttcagttttttctcctgaagctgtgaggccacgtacgcacctacgtcttcaggtgtcgccgcccccgccttctcagcttctttgtacagatcaatgccgttttgattgaatgtcgggtaggacggcagccaccctaatcgcgccgccagcacattgtaatcggcgtgatgcttgtagcgggatgaagaagcgatcggtgaagccaagtcactgatcggctggtcttcgtaacgccactggtctgtcgcaaagtagaaaaatgaggtgccgttttgcagtttaggcacgccttcccagtcctttgcggttgcgatcgtctgccacccttcagcaggacggagcttttcctgaccgacataatgagcccagcctccgccgtttacgccttgggcgcctaccaataaaacaagatttaacaccgcgcggtaaatcgtgtcggagttgaaccagtggttgattcccgcccctacgataatcatcgatctgccgtctgtatcaatcgcattttgggcaaactccctggcaatctgtataacggcttctcttttaattcccgtgatctgttcctgccaggcaggtgtgaacggacggggatcatcataagatgcggctgattgtccgccgatgccccggttcacgccgtagttggccaatatcaagtcaaatacagtcgtgacacacacctcttcaccgttcagttccagttttttaataggaagattccgctcaagcactttgtttccgtcatttgaaaaatacggaatgcgcaccgtactgatttcgtcctctattccgagcacggagagacggggctcgatctgttccccggtgtcttcatcgatcatgtgcagattccatttctgctgcccgtcccagcgggagcccattgttccttgcggtatggcaaacgcacctgtctgttcattccagaccgccggcttccattgatcatgctttgtctgccgtccgatatccttcgcatgcagaaaccgtcccgctgtgtatacgccattttcttttgataaggtgacgaggaatggaaaatccgtgtattgcttcgcgtattccatgaaacgttccgtctcttgattcacgtaaaattcctgcagaatgacgtgacccatcgccatcgccagggctccgtcagtcccttggcggatactgagccagtcatccgcaaactttgaggattccgcaaaatcgggactgattgaaatcaccttggcccctttatagcgggcctccgccaaaaagtgcgcgtcaggcgttctcgttaacggaacgttggaaccccatgtgatgatgtagcctgaattgtaccaatcactgctttccggaacgtccgtctggtcaccccaaatttgcggggacgccggcgggagatccgcataccagtcataaaaactgagcattgggccgccgattaaagacatgaatcgcgaacctgacgcgtggctgatcatggacatcgccgggatcggagaaaaaccgacattccggtcaggcccgtatttcatcactgtatacagcagagaggctgaaatcagcttcagcacttccggccattccgcgcggacaaagccgcctttccctcttgcctgtttataggacttcgctttttcagggttttcaacgatcgatttccaggcatccagcggattttgatgcgtctgcaatgcttcccgccacaaattgatcagcacacctcgcacatatggatatttcacacggagcgggctgtagatgtaccatgaaaaactggccccccgcggacagcctctcggttcgaaatcaggcatatccggtcctgttgatggataattcaagttttgtccttcccacgtgacaattccgtttttcacataaatattccagctgcaagaacccgtgcagttgacgccgtgggtggagcgaacgactttgtcgtactgccatctgtttctgtatacattctcccaatcacgatcttcgcttgtcgtttggctatgtttatttgaatgatgttcgataggagaaaaatagtttaatctcctgagcaacggactcattttctttttcttcatgatcgttcactccttccgagtcaggtgatgctatgtacactataaacagagacggcgcatcaccttgtgaactaagtcacacactctgcttttttcacaaaacgttcacacagagcagcaggaaggatttttaaacgatatgaggacgcccgcgtcatcaaaaaaaccggttctgtttaagaaccgggttcggcgttttcatccagtgatgtatgcagataccgcaaaaacaactgataggaacagaagacattttgctgaagcatcgccaaaaagttcatttgcagccgcggatggtaagacatcatttgcttaaatatagaatatggaatatggagtaccagaatatccggtgaggcattgactgagataaaaggcgataaagagagcccgcctttttcatcaatcggaaacacatcgcctttttcccacagcgcaacggtttgcgacccttcagggagcctgctgtccgtaaaacggatattgccttttaatacaatataaacggattgtgaatgaagaaaggatggagattggtcagatgagccgcggataaacgtcccgtttttcagcaaggtttcgacaatggacagaggcacttcattaaacataggaagttgtttcagaaataataaatagtcacactgattcataggaaagcctcctgtgctattgatagctttagtgtagcccgattgagcccgcgcggcagtgatgtatttcacagcttgtatgatgaaagtcacttatcaggagagtgtttgcacttataatgaaataaaaaggagggtttcgatgaaagcgatgattccgaagcagcacggcgcatgggcgatgctgctgattccatttttactcggcatggtcaagggaggcccggttttctggcatattccgctctttctgggctggctgttcctttacttgacggtttatcccgtttcgctcgctttgaaaaagaaacagcttcagccttatcaaaagtggatatggtattacggttttccggcctgctgctttttgatcatttctgtctttcataagccgcagctcgtctggatcggcgtttttttattgccgctgtttctcatacatacgcattatgcccgccgaaaaaacgaacgggcgctcacgaatgatattgcgggagtcttgttcttttgttcaggcgggcttgcgagctgctggctgggaacgggaatccttgacggctgggcttggtttctattcttgcaatccgctttattttttgtcgggagttctttttatgtgaaatcggtcatacgggagagaaaaaacagaaggtttgcttactggtcgtggggatatcacctcttgctcccctttttatcggctcttctcggggcaggctgggcgtttctcgcttttatcccaagcagtctgcgggcctggttttttcacggaagagactggccggtgaaaacgatcggcattctggaaatcgtaaatgccggcttctttttcgccgtcatgtgtatatgtatcacaagctgaaaaacaaggacaccggctgcccttgttttttcagtcaatattgcagatctcaagcggacaattttcacactcgatctcgcatcgtaaatagtcccgcttgtgcaaaataatttttccggtttcgtctatcgaaataaccccttgtttgcggaggtctcccagcatgcggttgacgctctcccttgccgccgcgcaaaacttagccaaatcctgatttgtcagcacaatgttaatcagaatcccgtcgcttcgttccaccccgtagctgtttgataagcggataagggtggaatagagcgccccttttttgccgtgaagaagcagatccctgatcttagactggatttttcgcagatgggtgctcatccatttcataaattcaaacgtcaaaacaccgttttggaccaattccttttccagcctgtttttattaatgacgagcacctccccgtcctctaacactttcgcactgagcatatatctcggctcatctgtgaatagcgtcaattctccgacaatatcgtgtttttggcagattctaagtgtcaggtcttttccgtcagatgtcagcttgccgatttcaatgagtcctgattgaatcagataaagctcttctgcatccattccttcttgaaacaaatacgtgtgttttttcattttccttttcgtactgatcgattccagcaattcatgcagttcgcgggaaagaagttctttatcagattttcggacagagagaatattcatgagctcacctcgaagaaagtcacgttgcgtatgtatattgtaacgtgacttgatttgcactcacccagaaaaaactaacaatcttgtgaatggatcattatgaatcaaggctatgactgtttctctccgtatgtgttttcattctttcctgccaatacatccagatcacaaggacaaagctggctaacgcaacctctgaaagcgccataaacccgatcgcgtattgacccgttgcctgaaatacacttgccagaatcagcggagggaaaaaaccgcccagtccgcccatggcagacacaataccgttggcaatcccagcttgcttcgaaaaatagaaaggcaccagtttaaataccgtcccgtttccaatccctgagcagactgccaccgtcagcgatccgaacgcataaaggccgatcgccggggagaatgacagcatgacgcctgacagcgtaagccctgcgaaaacgaacatcagaatgcggagcgggctcagtttatctgcaagaaaccctcccacaggcctgagcagcgtagagaccgcaataaagccggccgtccgcagaccggcgtccgcagggctcagcccaaaatgctcaaccaaaaaattcggaagatagatggtaaaggcgacaaaggcgccgaacgtaataaaataaaacaggctcaacatccacagcacatgatttcggtaaacggctttcatttgtgtctttatggaaactttgactttcttctcatgccggtcgccgaacaaaacgtgcagtaatgcgaaaacagccagcaaaacaagatacatctgcacggttgctttccatcccgcggcttgagcgataaccggcgccgcaaaggtagtaacggcggtcccgatgtttccggcaccgtaaatcccattgacgacaccgtgcttttctttcggataatatttcgggagggacgtcactccgatggagaataccgctccgccgatccctaagaaaaagccgcccgtgattaaatcaaataaagaatccgcgatactgatccaaaatacgggaaacaaaagcaggatgaagctgatcataaacatcagccgcgcgccatacctgttcgttaaatatcctaaaggaatacggagaagcgatccgagaataacgggaatcgccgtcaccaatgaaatctcgcctttgcttaaatgaatatctgatgtcatttgagaaatgagcgatgaaatcagcacccacaccataaaccctgccactaagcttaaagactgcagcgataattgaatatgttgacgattgatcattcggcttgcccctttcactgattcaatatcagtcttatcatacaaaaactcagtgtgctggattgtgaattacatcacacgctttatatgcaaaaaaaagaacaaagcccgaagactttgtcctttgatcatcattacattttttccggagcggatacgccgatcagctgaagcgcattgttcagcgtaatttgcgtcgccttcattaaagcgagacgcgcgcggctcttctctttattttccggatcgatgactttctccgcattgtagaagctgtgcagagcggaagccagatcataaatatagtttgtgacacggtgaggaatgcgtttttctgccgcttctgccactgcttcagggaagccgccgattgttttcagcaggtcatattctttttctgattgaatatggctgaaatcaagatctgccgccggtttaagtccctgctcctccccttggcgaagcatgctgcaaatacgtgcatgtgcgtattgcgcataatacacagggttttcattagatgtggatacggcaagatccaagtcaaaatccatatgcgtatcagcgctgcgcatcgcgaagaaataacgcacggcatccaagccgacttcttcaatcaggtcgcgcatcgttacggctttccccgtacgtttgctcatcttcattttttcgccgtttttgtataaatgaacgagctgaatgatctcaacttccaatgtgcctttcttgtaaccgagcgcttcaatcgccgctttcatacgcggaatatacccgtggtgatccgcgccccatacattgatgagcttgtcgaatccgcggtcaagtttgtctttatggtatgcgatatccggcagcagataagtgtatgagccgtcttttttgatcagcacacggtctttatcgtcgccgaacgttgtggagcggaaccatgtcgcgccgtcctcttcgtatacatggcccttttcgcgaagcgcctcgagcgcctgatcaatttttccgttttcgtacagtgacgtttcagaataccatacgtcaaacggcacgcggaagttttccaggtcggagcgaagtttatcaagctcgtactttaagccgtattcacggaaaaacgcctgacgttcgctctcctcttcatgtacgaaacggtcgccgaaatcttcggcaagctttttcccgattgctataatatcctcgccgcggtaaccgtcttccggcatcggtttctcgaggccgagcgcttcaaaataacggacttcaacggaaagcgccaggttgttaatctggttgcccgcatcattaatatagtattcacggctcacatcatagcccgctttagaaagcacgctgcacagcgcgtcacctaccgccgcgccgcgcgcatggcctaagtgaagatctcccgtcgggttggccgatacgaattcgacctgaatcttttcgccttgtccgatgtttgtctctccgtaatgttcacccgcttcaagcacggacggaatcagttttgttaagtagctgttgttcatgtaaaagttgataaagccgggccccgcaatatccatcttttcaatggaagctttgcctttatcaaatgacgccacgatctcctcagcgatttggcgcggcgctttttttgcgattctcgccagctgcatcgccatgtttgtggaataatcaccgtgtgttttgtctttcggcgtttctaacagtacgcttggaatctggctttcttccgccaggcccgctttcagaacggccgctttgatctcttccttcagcacgtccttcatttgttccgcaatattcatgcctttgtttcctccttatattggatcgtcatgttatgtacatgttcttggttttcgcctacagtcatgttatatgtcagtttgacggagccttccgaaccgccgacatcagattgaatgtttttcgtttccgtacggagctccatttgtccgaacggcagtttatattgagtgagtgtcgatgcccccggaatgaaccgctgtttcatttggatggcgcccgatctcattacgagaatctctttttctgtaatcttgacgaccgttttaatcttgcccaaatcatgctcttcgtgataggaaagatacgttttgccgtttctcacgtaatagaatccactcgatgtaaattcaaccgactcttcttcggagccgttatgaatgaatgattgcacatgaatggctactggtgtctcctgtctcatgctgacacttccttttcatcatcccgcttaacctgaatagtataagttttcaagggaaaaagttcaaccgcttcctcctatcttaccatctttgctgattggttttgaagataaacatgatttttaaggaaaatgaaaaaaccggaaatcctaggctgcgggataaatgcggttccttcggcggacggctttgtcaaaggggaaaagtttgcggtatttttgcgctatccttccgaatgaaaatgataaaatatgtcatatacataacgtggaagggagggattcggaatagtggcgagtgttttatcgtcttcagcggttggagaaaaaatcaacgaatggtatatgtacattcgaaggttcagcatcccggacgccgagtacttgcggagagaaatcaaagaagagcttgcaggcctggaagaagatcaggatcttcatctgtactattctctcatggaattccgccacaatctgatgctcgaatacctcgaaccgctggaatcgcagcggatagaagaacagccgagactatcggatctgctcgcggatattgataaaaagcaggcccggctgaccggacggcttgattattattttaattttttccgggggatgtatgagctggatcagcgggaatatttgtcggctataaaattttttaaaaaggctgagacgaaactctcatttattaaggatactattgataaagccgagtactttttcaagatgtctgaagtctactactatttgaaacaaacgtatgtatctaccgattacgcaaggcaggcatatgaaatatataaagctcagtcgtcatacgatatcaggctcatacaatgccaatccttattcggagcaaatttcctggatttaaaactatatgatcgggcaattactcactttcaaaaggctttttctttggcagaaacagaaaaacagcctcaattaatgggcaggacgctgtataacatcgcactttgcaaacaaagcctgaacgactatgaagcagctataacttatgttgaaaaagccattgatgtttttgaaagtgctaaaatgaccccttctttgccccaagcatattttttaatgacacagattcattataaattagaaagatacgacaaagcgctcgagtatcataaaaaaggagttatctattccgaagagtcagcagattcagtttatttacatgaattcgaatttttaaaatctttgtatgtgaacggacctgatgaggatgcaatgaaaaggagttttgactttttggaaagtaagatgatgtatgcagatatagaagattttgctcttgatgcagctaaatattatcacaaacttgaagattataaaaaagcttcaacatactttttaaaagttgaagaagcaagacagcatattcaagggggggtaactttttatgaagctgaagtataaggtcttactcacttgcttagctgtaacctcagtttttataacagcagatatgacgaatacaccttcacaccaattcgaagtagcacaaagagctatgatttaaatgataattacttttaggcttgcaggttaaactgcaagccgttttttatataaacaactaatttacaaaaacaaaaaacataccttagaactcaaatgtgtaaaaagtatttgacacttatacatatattatttaaaataaatatatataaatttgaaaatttaaaataaaaaacaaaataagttaaggagggttttagtggataacaatataaaaaaacttagaacagcagctgatatttcacaaaatgatctggctaagctctgcaatgtgaccaggcaaaccatcaatgcaattgaaaataataaatatgacccgactttaagtctggctttttcgatagctcacgctttaaatacgggaatagataaagtattcaactataacgccaaaaaaaattaagggagcggttcttatgaagaaaatggatgagatgcaaaaacaccaatcgggtacagccgccagaatagcatttagtttttatactgtcgctttactgatatggtcattaatagattattttaaaaacggaaatacaggatggcaatttccgattcttttaataggctgcgcgctctatttatggattcaagtttatcaaaatcgaaaaacaaggtaacgattccaatacacttccggaggattatacagcaatgtacgaatacaagttcataaaagcagaagtaaaccgatggaaaggaaagcctaaagaagactataaataaattattgaaaagtattcgcagcaagggtgaaagctggttcaaatatttgctcctgctatttcaggctatggggcagctgattattttgatattatttttgaaaaaaaagtataatgtttcagtaccaaagaaagccggatcatacatatggtccggctttctttgtacgaaataagccagcagatacttttacggatttcacctcttaactattattttttcggaaatccgcaattcaaatagattccaatatattttattatttaacttgctggggatattgaaaaaattggaggaaaaaatgaatctacttttaaaaacacaaaatagtaaagcgatttttacattagtagcatcaggaatcattgttctcgctcttttcagtatgaaacataatcatttaagcatggatgttatcgatattttaaacagagctggaattatcgctcctagttggattgtcagtgctatcaccgcaacgggatcagttctggctatcattactgttttaggatctcttggtgcaggcttgccattggccgttttagaacaattggctgcagcaagtacagcagcagcataatataaaacattaaattcaatatccctggcagtccctttaacgaatggatgaaaatacattgtttaaaaagaatgttttagtcaaattgtacatactctgtctgatcttatttttaattgctttatttacagcatatatttatacagattccgcttcaaatgtaaataatctaaatcgaaatatccgtccggatttttttcagattttctttaataatattaaagtagcgagtctgcttgtttttttaggcccgttaacgctgtcgcttggcacggttgctgttttaattattaatggattaattttaggaaatgcgataggaaacattaaagacaatttaaaccttttactgcttgttataccccatggaataattgaagtgccggtattgcttcttgcagcctctgtaggaatgaaattaactttagatttattactcctcaaaataaatttgaaattcacttttaaatatattggtattatatttctcggtttaatgatagcagctatgttagaaacatttattacacctatctttataaaaggagcctcttaggattatgcaaattgaattatcttcatttaaggaacgaaacattaattttttgtcctcgtttttgttttatattatcgggttagctttttatttaagttcccttttaccttttatgaaaagtttaattcccaaaaacatccctatacaagttgttgagcaagtaaaacatttagattacatcattgcaatagccgcactgtttcttttaatgttcggggtcatttttgaaggattcgtattatttctcattataaattttcttggcgctcagattaagatcaaaactttttattccctatttatgttttctaacatcccggtcgcgattaagttttttcttatatcattcaaaaatattttcgcacaacatccaaacactagtttatttttcacaagtaatcatttgattttttctatctttgatttgttcaatattgcatacttatttcttttgtttattcttctgaaatggagaacaaatttgaactacctgacaatctcagtttttatttttacggcattcctgtatagaatgtttttttagcatatataaataaaccccctcaataggggtttttctttcatttcgttcactgtatacaattccttttatatgcttccgaaacaataccgactctagtacttacattccactttttacaaagaccggctatgatatattcgacattacgctgcgagtagtttaatgacttagcgatctctttattaggcttttcagcaattatcagtttaattactgaaatttcaatcttttttaattccaattcattttctactgctgttttcattctaacttcctttctaaagatgtatttactaaataataccctattatataatttttatcaataacatcaattattaatagtaaaataatatatttcttttactaacttctaagtagtttatatacaatataaaaatcccccgccatgtttcaagcgggggaaattctttctatttcacaaacccaagcagcatttcacggatcatcttgcttgccgtgtttgcggtttgttctgagtggtcatagaccggtgccacttctacgaggtcggcgccttttacgctgacctctgagcgcgcgatttcatggatggacgcgagcaattctttagacgtgatgcctcccgcgtcaaccgtgcccgttcccggcgcatgagcggggtcaagaacgtcgatatcgatcgtgacataaaccgggcgtcccgcaagctgcggcagcacttttttcagcggctcaagcacttcaaacttagaaatgtgcatgccgttttctttcgcccattcaaattcttccttcattccggagcggatgccgaatgaaaatacgttttgcggcccgatgagctcggccgctttgcggatcggagtagagtgggaaagcggttcgccttcataatccgtgcgcaggtcggtgtgcgcgtcaaaatgaatgatggcaagatccggaaacttcttatacatggcttttatgacaggccatgatacaaggtgctcccctcccatgccgagcgggaacttgcctttttctaggatgccgtccacgtattcttcaatcatatcaaggcttctttgcggattgccgaacggaagcggaatgtctccggcgtcaaagaaattcaaatcagccaagtcacggtcgaggtacgggctgtattcttcaagaccgatagacacctcgcggattctccccgggccgaatcgtgaaccgggacggtagctgaccgtccaatccatcggcatgccgtaaaggatggcgtccgcctctttccagtcggggcggctcgcgataaatacttttcctgaatatgcttcatcaaatctcatcaataattccctcgctttcctgtaaaaaagcgcaagattcgctcctgcgccgtacgtttttatttgattaagtcgctcacaaatttcggaagaacaaatgccgctttgtgaagctctttcgtgtaatacttcgtgtcgatgtcgaagaaacggctgtcctctacttcaagcggatcgtactttttagaaccgatcgtaaatgtccacaggccgctcgggtacgtcgggatattagccgtatacagacgggtgatcgggaagatttctttcacgtcacgctgtacgtttgtaatcagttccggtgtaaaccacgggttgtccgtctgcgcgacgaagatgccgtcttcttttaacgccttggaaattccggcatagaagccttttgagaacagattgacggccggtccgaccggttctgttgaatcaaccatgatgacgtcatactcattttctgatttcgcgatgtgcatgaaaccgtcatcgactctcacgtcgacgcgcggatcatcaagcttgcccgcaatggacggaaggaattttttagagtattcaataaccttgccgtcaatgtcgacaagcgtcgctttttttacgcttgggtgcttcagaatctctctgatgacaccgccgtctccgccgccgacaacgagaacgttttccggattcgggtgcgtaaataacgggacgtgcgcaaccatttcatgatagacgaattcgtctttttcagatgtcatgaccattccgtctaagaacagcatgttgccgaattcttctgtctccaccatttccagatgctgaaattccgtctgttccgtatgtaatgtttgtttcacctttaatgtaatgccgaaattcttcgtctgcttctccgtataccaaagctcgctcaattgtcatctccctttcaaggcttatttcatttattgtaagcgtctgtatcgcttttattccggttaaaatctcattttcacctaaggaaaaagtatagaggatggaggggaaaaagtaaagaagtgtccggtttgatatgtttaaaaaacccccttttttcacataataatagaatcatgaaaaagggggttcccaaaagtggataaagtatctggaaaacagctcagaatcacgttcaaaatcatccgcgcctgcatctttctgacactgatcggcggaatgctggccggcgtctgcttcacatccgttcttcttgcagcgaaatggcagggcgccccctccgtccgggttcctcagtctacgattctttatgcaaatgacggctcaaagctaggtgagaccgatttcggggaaaagcgctactgggttcggttaaaagatatcaatccgacagcggtgcaggccgcgattgcggtggaggatcaaaacttttacaatcaccacggttttgattaccggcggatggccgccgccgcgctggctgacataaaggcaatggccaaggttcagggcgccagcaccatcacccagcaatacgcgagaaatctctaccttgagcatgataaaacatggaaacgaaaatggaacgaagcattttacacgatccgccttgaacagaactattccaaaaacgagattttagaaggttatgtaaatacgatatattacggccacggcgcatacggaattgaagccgcctcccgcctgtatttcggcaaacacgccaaagatctgaacgatgcggaagccgtgcttctggcgggcataccgaaaggcccgtccggctattcgccatatgtcagtgaaaagaaggccaaacagcgccaggaaaccattctccgtctgatggccggacaaaaaatgatctcaaaagaaaaggcggaaaggattaagaaaacgccgcttgcctatcagccgctgaaaagcagaaccgcggcgaaaacggcgccttatttttacgatgatgcgatgaaagaactcgagaaaaagctcggcatgacgcgcgaacagctcgcaacgagcggattgcgtgtttatacaacgcttgataagcgcatgcagcggatcgcggaaaacactgtggcacatacgatccgtaccggctctgacattcaggtcggcttttccgcgattgatccggcaacagggcgcgtgcttgcgcttctcggcggacgtgactacgaaaaaagcccgtttgaccgggcgacacaggcgaaacggcagccggcttccacgatcaagccgcttttgtattacaaagcgattcaaagcggctttacaccggtcacgctgatgaaaagcgaagccacagagttccagattgacgacaacggagatacctattctccaagcaattacaacggctactacgccaataaaccgattacgctgcttcaggcgcttgcgttatcagacaacatttatgccgtgaagacccatctctttctcggcatgaataagctcgtgtcggcggcaaaggaattcggcatcagcgaacatttaaagccccttccgtctctggcgctcggaactgaacccgtgcgcccgattgagatggttaatgcctatgcgatgctcgcaaacgggggaaaacaaatcaccccttcctttatcacaaaagtgacggataccgccggcaaggtcttgtatgaacagccgcgcggacatcagcagacgcttgataaaaaagccgcttttgtgacggcgagcatgatgacgggcatgtttgatgaggatttaaacggctatacttccgtcacgggacgcaccatttcagaccggctgacccggacgtacggcgggaaatcaggcacgaccagcgcagacagctggatgatcggctttaatcgggctcttgccgccggtgtgtggacaggctatgacaaaagcagcacgattgattcagtagaagaaaaaagctatgcgaagacgatttgggcggactttatggagaaggcgctcgaaggagaaccggaaatagcgcttaaaccgccgaagggcgtcacgggcgtctatattgaccccgcttccggctacacttcgggacccggatgcgccgcaaagcattacacgtatttcatcgcaggcactgagcccgcggatgtgtgctacggaccggaaccgtctaaaaaagaaaaggaacacgtccccgcccgtaaagaagctccgcgcaaaaagtggtgggataagtggctcggcaaaaaagactgagcccggtgcattgcgcgccgggcttaatccgcgtcttcctcaagcacccatgggagcaagagtgaaaagtcgagatggataatagggtcaggaaaacccttcggtataaaaaatgttgtactaggcaaagaaaacgaaaagcggatatctcccgctctctcaatgtgaaacttcggccagccttccctaagcatgccgacaatcggatagctgcccgcataatgatgcaggccgttttcctttccatgctcccccaaatcgtgacagacagccggacgaatcccaaactgcgtaaacaatcttgttttctcggcgggaaggagattcaccgcctcggaaaagttccggcagctcccgcaatcgcagggatcagcccatgatttttcatattgttttctcgtttccgccgtatctgcttcaatgatccaaggcccgatgtcaaagacggtgaacatgatgaaacctccgcgtaaacatgaaaaaccccgagtcttggttcggctcgggactttccatgtcctgattctgtatcaacagtttactcagtacaattgcgaaatagtgcaaatatttataaagttcacaaaaagttcacaaattatttttcgcccggaagcagacctgttttcaattcatcggatgaacgttcccagagcccttggtcatgcttctgcagaaattcagcaagcacctgctttgagctggcgtccattttgtccacgataatgcggcgcttcattgatttatccattaaattcacatgctccggcaatgacttatagcctctgcggatacttctgtccacggtcatttcacaagccgtcacacccgcgtaataagggccttctttttttctgtcgatggtgacccacacgagccagtacggttttccgttcggcacttcatctttgttcggcaggaatttgatgcctttttcaacgacactgcgggcatgcattgcgccgatgtctacgaaagcttccttctcttccacatcgacaaataccggagaaatattgtcaaggctcagcgacccggcgccaaaaccgccatgtccgtcggtcggatcacttttaataatattaaatccgattgttttcttctttttttcttccatgaaaataccctcctacaaaagcggttgaaatataatggcaaataccttgagaatccagtctctcccctcgcttaacagcggccacacgacataggagccgaccggtgtcacaaacagcacgagaaacacgataatcccgtagctctcaaactgagtcattttggcgcgcacccgcggcggcacgagatcctcaataatccggtagccgtcaagcggaggaagcggcagcaggttgaataaacacagcgcgagattcagctgaatccaaatagagaaaaagcggtcaagccccatgctgaatgcagaaagcagctccattccgtaagcatgcatcaacactagcaaaaagaaaccgataaaggcaagaagcaggttgcttacgggcccggcgacggaaactagcactcccgccagccgcggtcttttaaaggcgcggcggttcaccggcaccggacgggcccagccgaaacccgcgaccaaaattagaatcgttccgaaaacatcaagatgtttaatcggattgagcgttaatctgccctgtctcgccgcggtatcgtctccgaaccgatacgcgacatacgcgtgcgccagttcatgcatcgtaaatgccacgatcagcgtaatcacgacatagggcataagctccagcggataatataaaaatctgtccaaatgtcaaaatcccctttttttaaaaatgcaagattgtccttcattcagtatactataagtgatctctcttccaaagagaggaaacgataaaggaggatcagcaccatgccgctcgtaaccgttaaaatgcttgaaggccgcacagatgaacaaaaacggaatctggttgaaaaagtgaccgaagccgtaaaagaaacgactggcgcagccgaagaaaagatcattgtcatgattgaagaaatgagaaaggatcattacgccgtcgccggcaaacggatcagcgatacggagtaatccttgataatggccggcgctgctatgtcaggccggcttatttcacaaccttttcaaccaggctgaaaaagattttcttttcttcctctgtcaatgcttcgaacagttcgtcaatgagcagctgccggttttcaatcatttgcatggccgccatttttcccgattcggaaagcgtcatccataccgtgcggcggtcttcattgtttctcgacctttccacgaatccttctttttctaaatgattgagagcggttgtcgtggcggaaggcgataatgtgacctcctgcaatatatctttaatcgtgcacgtgccgtgccggtaaataatcctcagaataaatcctctgatattgtttatactctttggaattgtcgcctcatcaagctttttcgtgctctttaaatatttcgtgagcgcgtaatccagtacatttgcttgcaagttatcgtgcttcatgcagaaactccccatttcaagatgcatccatcatcatttgtttgttttttattacattttactgataccttacggagaaagtcaaaattccggccggaatgcccgcaacttttatcctgccctgcacagacttttgtctccctcttttttaccatatccttttatgcaatgctggttttatagacacgattcaggtaaaatcattaagggtgactgcgtttgacggtaaggataatctgatcggatgcggcagacaatatgattggaaaagaaaagaaacggaacagacggggaaacagaacacaggattgtcgattacacagaagatgtgacacgggtaaaagccaaagagtccctcttggcttttgcttttggatggagggatgcgtgttgcggaatatcctacaaaaaaaagacatcacccagctgcttgaacaaagcagaaaaaggcagactgccaaaacgatgggtggatttgatttaacattactgggcatcggcgccgtcatcgggacgggcgtcatggttcttacaggcattacagccgcgaaaaacgccgggccttccgtaatcttttcttttatcattgcagccgttgtctgcagccttgcagcattatgttacgccgaaatcgcttctgttctcccggtttacggaagcgcctatatttactcttataccaccatgggagaaattgtcggccatttaatgggctggacgctcttatccgtttatatggtgacggcgtcagcggtggcaagcggctggtcaagttattttaataatctgttagccgaaatcggcatgcctttgccggacagtctgctgcacgtgccgagccaggggggatcgtcaaccttcctgccatcatcattactctattaattgccgtcgttctgtcacgcggctctaaagagagcaaaacctttaataatataatggttctcgtaaaaatcggaattgttttgctgtttatcatcacaggaagcttttttgtaaagccgggcaattggcatccttttatgccttttggaattaaaggcgtcattacgggggcttctgccgtcttttttgcgtttctcgggtttgacgcgatttcggcttcggctgaagaagtcaaaaaaccgcagcgcaacctgccgatcggtattatcggttcactggtgatctgtacattggtatacgtcatcgtctgtctcgtcatgacgggtatggttccgtattcacagcttaatgtgccggaagccatgtcttatgtgctgcagactgtcggacaaaacgcggtggcgggcattatcgctgccggtgcggtgatcggactgatggccgtcgttcttgctcatacctatgcggcgacccgtatatcttttgcgatggcaagagacggaatgctgccgaaagtctttaccattgtcggaaagaaatcgggagcgccgatctttaatacgtggctgatcggactgatcagcgcatgcatcgcgggttttgttgatctgaaagagctgtcggatctctcaaacatcggcgcgctattgacatttgccatggtcagtctgtccgtactgattctgcgccgcacccataaggatctgccacggggatttaaagtgccttttgtacccgtactgccgattttggccattatctgctgtttgtttttaatggtcaatctgccgctgaaaacgtggctttattttgccgtctggctgatcatcggcgtcatcgtttactttttatattcgtacaagcacagcaaattgagacaataaacaaaaccaggcccgcttcatcgcggcctggttttttcataaaaaaagacgaaagcatcgcctttaacaaatgtgtttcagctcttctatgtagtgaagcgcctcatcatattcttcatccgtatatttctgtttgctttttatcgtaaacactttctctttcttttcctcagcttcaaggccgtcaaaatacaaaatcgtagacaccagctccagaaaccgggatgagcggctgttgacgctgtcgatgtacttcttcatatccggcatcttaagctccgcatgatgtaaaaactcggctcccgtctccgtcagcgagtaccggtattgaaagtagccgccctttttttccttcacctcatccagaaacccaagattgcacagctcttcaattcgaagcgtcagttcttcggaatacgggccgtaaaaatgaaaatcatatttttcgtagaaaggatactgcattttcttcgcgatataaatgattttctgcagctttttccgcccgatgatttctccagaatccgagaacaccttcatcagttttgcatgttctttcaacaaattcccgacatctccttttccttctttaccaaaatccttctatgtcagtcccagcagctgccggatttttaattttgcttcagggttttctgaatcgtcgcaaatgaggtccatcggatagtagagcttatggtccgtccggcgtttgcccgaaatggattcgacaatggcggactgcctggacagctctttgatctggccgttctgcgttaacagatgaatcggcagacgctcctcctcttcacccggccggtaaaaatcatacggcagatccgatgaagaatcgaccactaaatagtaattgggatcaattcccgcctctttaaagagagcggtcagttcaaaataagccgacatttcctcattcggattaaattcggcatattgaaacagctggcggttaatgaagcggcggcacaagtcggacagaatcgggtcctcttcttcctcccaagcctggaaataatataaaatgatggcttcatcaagcttcagataatccgcaagcgtcagcttcccttcaaaaatggaataaaaatgaacgggagcatgagtgaatatatacccttcttcatggagctgcttcgcacggtggagaattttcgtcaaaatgacttcagcgcttctcgtcacgggatgaaaatacacctgccagtacatttgatagcggctcataatatagtcttcgacggcgtgcatgccgctttgcttaatgacgatctggtcctctcgcggacgcatgacccttaaaatccgttccatatcaaaatgtccgtagctgacgcccgtatagtatgcgtcccgctgaaggtaatccatcctgtcggcgtcaatctggctcgaaatcaggctgaccacctgtttgtttttgtatgttttggcaatgacttcggcaacatcctgcggaaatcccggtcccgcctttctgagaacctgattcacctcggtgtcgccgagaatgatttccctcgtatagtcttcatgatccagatgaaaaaccttttcaaaggaatgcgaaaacggcccatgtcccaaatcgtgcaaaagcgcggcgctgagacagagttcgcgttcattgtcatcccattcaggacgccctttaaaaacatcatcaaccattcgtctgacaatctcatagacgccgagagaatggttaaaacggctgtgttccgcgccgtgaaacgtcaaatacgtcgtaccgagctgtttgatccggcgcagccgctgaaattcacgggtgccgatcaaatcccagatcagcttgtcccgcacatgaacatagcggtgaacgggatctttaaacactttttcttctgataattttccgtttggatacgccatcgtcattccctcttttttttagccgtgattctattatatcggctctgtaatttgaaaacatccttgaatttgtccggcgttttgttccagttttcaatcattgattttttgaagcaaaaaagcctgacccatcgggcgaggctgtcgtaaaaatgcacatttactttttgatcttctttttcactttctcaatcagctcgtcctcagtcggcgccgacagcgggcggttgtttacgaaagcaaacgatttcttgcgtccgggcccgcaatatgactgacatccgacctccacttttgcatccgggtcagcttctttcaaacgcggcagcaatgtcttaatattggtggcctggcaatcatcacacactcggaattcattagccatgatgtacgcttcccttcattcaatgttcctctatgttaaatcttaaattttaaaaacgaaaaaaatcacatcacgttttattgtacaaggattcatcttatcctgcaaggctctgcgtatctctcattctttcagccaatttgtataaatattttccaatctggacattctaataccatcaaagattattgggggttgagaacattgacaaagcaaagacaggacgcctggtcggaggaaaatgacctgctgcttgcggaaaccgtgctccggcacgtccgggaaggaagcacgcagctgaacgcctttgaagaggtaggcgataaattaaacagaacgtcggcagcgtgcggattcagatggaatgccgtcgtgcgccatcaatatgaaaaagcgcttcagcttgcaaaaaaacagcggaaacagcggatgcgcgcgctcggaaacggccagccggccaagaagaaactattataccagccgcctgcaccggatgcggacatcattcaagaaaccgcagccgaagagacggttcaaacggaagcgccaaaagaggatcggcaagccgtcatgtccggcgaacatatgccttatgtcgatgaaagcttcaaggaagagttagctagtttatcacatttgctggcgcctcagcagccgagccaaaaggcggagctcacaatggcagacgtcattcaatttctgcagagctatgaaggcagcggaaagcaaacttccgccctgcagatggaaaatgaccgtttaaaacgggaaaaccaagaacttcagtctaaaaccgagcagctggaagcggccgtcgaaaaacttgaaaaagatcaaaaaaccattcaggaagactacgaaaccttggtgaaaattatgaacagagccagaaaactagttttatttgaagacgacgagcatgcgtctccgtcctttaaaatggaccggaacggcaatttagaaaaaatggccgaataacgcaaaaaaccccttttcttgtcatggaaaaaggggtttttgccatttgtcaatgacgcgcatcctgatctatattaatgtaaacattgttcaggaggccttcttcccgcaagggctgcgcatctcggtccccgcccgcacataagcataaagattcaattcctcatcccaaatggttcttgggaattattgatcgattagctactgtgcaatacactgtatagagaatacaattattagatatgatgggaatgatagtaaatgagtagccaattacgaaaaggagcattggaactttgtgtgttgtccctgcttctttatgaagatttatatggttatgaattaatcaaggtcataagtgaaacgttccctgtatcggagggcaccatctaccccatattacgaagacttacgaaaaataactatttaaaaacgtatacagcagcttcagatcaaggcccgtcacgcaaatattacaaagtaacagaagaaggcgccttttatcatcacacattaaaatcggaatggcttgacctgtccgaaaaagtgaacagcatcattaaggagggaaaatgaatgtgtaaagaccaatatttaaaacatctccggcgggaaataaaagatctgccggaatttgagcaaaaagagatactcgccgatatcggcgaaatattccaaatgggcgtcgctgaaggaaaaagcgatgaacaaatcgccggcaatttaggaaaccccaaaacacttgcgcgcgccttaaaagcggatattttcatcagtgatgccgaggagcagaaaacatggcgctcctttttcaaagcattcggcctgatgctgggtatgggcatgttcaacttcatgtttatgctgacaccgtttctttttgcctctgttgcggtgttaagtttgatggcaatcggcctgatgctgatgaccggatcattctttctcctcataaaagtgccgattgtaacagccatttttaacggatgtatggtcctcggagcgggtatggcggtgtttatggccggatttgatctttcgaaactgatattccgcatctttttgcgctatttcaaatggaatgtcagcattgtaaggagggaaaccattgaatcgaaaaatgtggtatagcattgctctcattttaatcgctgccggcctgatcggaagcatgttcttcggttttgacggcttttaccctaaatcataaggaaggtgtgcaagtagcatgagtgaaccagccctgatattaaaagatgtctctaaaaccatcaatcatacccctattgtacagtcaatttctttcgatgtgagaaaaggcgagatattcggccttttagggccgaacggctcaggtaaaaccactattttcagaatgatcgtacagcttattaaaaaaacagaaggagccatttcattcagaggcagaccggacagcgactttgaatattttatgagacatatcggggttatcattgaaggcccggatatgtatccgaatatgaccgctttgcaaaacctaaaatattttactaaactgcgcagcacctcgctgcgaacggatgaccttatgaatacccttgcaaaagtcggactggagcaggctgcccgcaaaaaagtgaaacatttctcattaggcatgaaacagcgcttggggctcgcttattctcttcttcacaatcccgggttattaattctggatgaaccgatgaacggtctcgatcctaaaggtatgaaagaattgcgcatcattctttccgatttagcgaagcaaggggtttccattttattatcaagccatttattgtcagaaatggaggagatttgcgacagggttgcctacattaaaaagggacggattttaggaattgaagacatgaagagcagaaatgaccttggtcagaaaaagctgtttaccgtcacggtcgatcatccggcaagggcgaaagaaatattagagcaggacggtattcttcaagtacagcaaaaagacagccgcatcattgaattggaagcggaggaagataccatcccgtatatcattaaaactttggcagagaaagagattctgatttcccgcgtttctgcaaggactttgtcattggaagagaaatacatgatgattacagatcaggaggacgcggtatgagcatatttcatctgacgcagaacgaattcataaaaataacccgaaaaaaaggcacacttttatctctttttttcctgtttctcatcgttttgctggccggccttattatgaatcatgagttagatgcttcctcggataacaattggaaagaacggcttctcgccgaaaaaaaacaggaagaaattaataaaccggctgaaacggcaggcgtttattattctgctgatgttaagaataaagactattatttggagcataacatcaacccttatgaatggaacggctggaggtttttcggcacggttacttcaaacgggcttgagattttcgtaagcttgactgcgattttaaccgtcagcggggttgtttctaaagagtttgcccttgggacgattaagtttatcgctacaagcccgaaccgaagatggcggattttaacatcgaaatttctggcctctcttctgtttaccggcatggtttacttattttactgtgtgagctgtttgctgatcggcggcgtgttattcggtttttccaatgcttcatatccgctcgtctatactcatttaaatgacagtctgtataccatcagttcaatcaaagcatccggaatcattctgcttttgcgtttcatatcaattataagtattgtcaccattgcgttcactttgtcagtattgtgcaaaagccaggcgctctccctttgcttatccattttactgctgtttgccggcagtatattgggcggaactgatttgcttgcccaatttacatggtataaatttacactctttccgcatttaaacctcgttgcttatgtaaataaaagtgcgggtgatgcgatttcaacgttaaacatcccctattccgtgacggttatagcgatctactttcttatttgtttattgatttctttttccgtctttcaaaagagagacattacagcatagacagagaggcggcggcataatgagcggacggcaggaaatattgacggtccagcaatttgccgctgaccgccccttggtccatcgctaatggatttaaataaccgaagcttccgctgcttcgctgctgaaagcgtagaaattcccgcccttcccgtataaaaagcgcctcatcgaatcggagaaatttcataatggctgtgtattttgcaacggcgtcaatgtgatactttctgcactcggctaacattaaacctgaaaaagcaaagtctgatgttttgtaccattccgtgagaaaaggctgcaattttttcatttgcaaataagagacggcataaagggcatctgcctgctcttcctggatgctgcccggtgccatgagcaaatcggcctcacgtttcattgcggtttctaagaaaacgatcagttcttccggggtcaccgccccaaaataagctgctaacaccatgaggatcatagaggaaggctctgatttcagttcctcttgtaaaccgcggaccatttgttcaagtccgttatgaaaaaagatgctttttgcggcattcatcctgcggtatatatgatacgcatacgcgaacaggaccggatggcattcgtgcgttttttctccaaaataacggtctaagaatagaatgacttcttctgtatcctttcttttttcaaagtgatgacatgccgctaaaccgcaaaacaggtgcatgagatcatctgcttccatttcttccggctgcagctgaatgttcttccaaaaacccagcagccattcttctgttttttttatattaaaatgttccttgactatccgcatgttccacactccagattcagaatctcaatcgccggcagaagagccggagcacaatgaatggatggattctcgttatttatatgatgaagagccgcttgacagccataaaaaaatggatcgatacacgattggataaataacatattgcacagctgtttcatttttcggctgccgagacaaaacacaagccatttttgaatggacgccttcaagccgggatgaagcagatgctctccctgatctaaatgaagaagacagtactcgacaaactccagctcgttttcagctgttcttttccatgcgtcatggagcaaaggctgaaatatcgaattcttgtaaaagcgcactttttcatggtcagttgacattcccagctcgttcagcaaaccggcgaattcggcgtatttaaaataaggccattctttttttataagatagccgttttgcaatccgtgacgtatgacttgatcatccgaatccattccctgcttctttttataagcttttgccgttaaatagatatgaatcaactcattgacaatggccgtgttacagtgaaacagatcttcccagcatgacttatcaacgaaagcggaggcaatcctttcagtatgttcttttacagcggaagaatggctcgtctttctgtagtatttgcagaagccggcaaacagctgaatgctcttttgatccggaagcgattgttcagcaaaagataataaaaattgatccgtctcttcagctaatctgttcaagttaatcgttcctttctgctctaaggcaggcatgcgcggcacccgcggcgacaagtgttgtatgatagcaatgtttaaacacatcttctcttcgctgttcacctttcaaaccgggtttatgttgataggtgatgctcgggacattcccctctttcatttggccccgatagattttattccaggctgcttcatagagcggtttatggttgtccttatccatgtcgatatgtaaaaaagagctgcacatcaataattcactggtaatatctaaattctcaagacagatatagatcccgagaaatttcaggaccttttcttttaaggacgacagatgatactctttatccgtaagagaagaacatcccatgtctgttatataaaaaatcgtatgagtgatactgtatgcatcatgatccgtcatatatgtatttgggatatcctgaccagctgctgtgtagtgatataagtcagaaaaatccgttatttccgaggttacgcctgctctttgcagactgtacttcagatccatttttcgaaagggaattttagcaaggctgcaatcaaaacgcgctgccgtgaatttttccagctcccatatcactgaagcttgtgacggatgatcagtcaaggtaagaaattcacccgcaatagccaatccggcgagaccgtccggatcaaaatgaataaattcttcaagctgatcattacggagcctttctgtaataaactccgttaaaacagcaacttccttatcatctgcctgatttctgatcaggtaattggtaagaaaaatgagttctataaatgttttaaggcgccatctgaaatcattcgctactttatgtttcatatcaaaataatggatattttcaacaatccatgacagtgctccccgcttaatttctcttatatactcttgtgtcacactctcaccgcctcgtctcgaatgcgtaggctccaaacagtcattatcttacttttgagcggctaaatcagagaaattcaaattcgggttttgattgtcttcttggctcggcactacaagcacccagccgctccaagcgaaagaattgcctgattgttccgcatctccggctaacaaatgtgtagggatcgtgattcttttttcttcttttatttttttaaagttcatatctccatctccttcagtttatagaattatttggaacctacataaatatattaatcaaataaggtatataatgtaaactagttttgatataacgattctttttcactataactgaatagtatataattaccaaaaataaaaaagcccggactcagtccaagctttcctgcgtgccgaacaccttctcattccgttccagcattcggatcagatttttttcaaataccatttcctcttccggcgataatccggctgcatacaggcgtccgctgagttccttcagttcagtcaaaagcgccagcattaagtcctgcacggtaatgtccgtttgcagcaattcgcttaatgaagccatcgtttcgggccggatatcgggatatacgccttttgtatcgttgcttttgtcttttaaagcggcttgatagaaacgtctgatcagatcggcgcgttcgcttccgcttttatcggcacagaggtaaatctgaaccgcggttccgccccgcaggcgtctttgtgagattcccgcgaattttcggccgccgatgctgagatcatagctgcccggacagtacgatcctttaatttcatatgcttcaatttcggcattgtacggacacagcatccgccgcaccagctctgtcatcgcctcgtagcctctgtcaatgtcgatgccttttttctcatcttcaaaaataagagaaatattcaatacgccttcatcgagaacgaccgcgaggcccccggaattgcggacaatgacacggtagccttcgccctccagcaatttcacgccgtcctctaaaaacggcaggcgtgtgtcctgaatgccgagcacgatcgtccggtggtgcacccaagtgcgtgccgtcgcaggcgattcccctttgcctacggaggcgcacagcgtatcatccattgcgaatgactgcttcgcatcaaaataagggccaaggctggattggtcaatgattctccagctcggctgcatcagtaaatcaatcggttgctttcccatctatattaaatccctttcgtcataagctttccatgcgtttattatatcactccgcttgagatgattgaaattggcttttcaaaagagcgatgaagatttctttgttttttgtgttctccataatggaagattggatgatagacagtttccgttttaaggagaatccttttatctcaagcacggaaatgctgccgtgaagcagatccttttgcagcacgctttttgacagaacggaaagacccattccgctgatcacggcttccttgacaccctggttgctgctgatcgtcatcatggatttcggccgcagtccgtttgattgaaggacgtggtctaaatattccctcgttcccgaacccttctcccttgtcacccacgcttgattttgcaattcggcagccgggatgttttttctgccggcgagcgggtgtccgttcggtgcggcaatgcacaattcatcctccataaacggctgaatgtcgagctcgtttttccccgtatgcccttcaattaatccgatatcggcttgaagcatccgaaccgcttcgctgacctcctccgtgtttccgatcatgacgtccaggttcagctcgggatactcgtcatgaagctttgcgagaagcggcggcagaatatattcgccgatggtaaagctcgcggcgattttgagcttccctttgacataatgatggtgggcgtaaatttcagatttcgcctgttcgtacaaaaagaccatctgcttggcgcgctgatagagaatgtccccgtcggcgtcgtcgtaaagtgcttcggagagcggttcagcaaagcggtttgaaattctttctccaggtttttaatgtgaaggctgacgcttggctgagaaatcatcagcttctgcgccgcctttgtaaagtttttttcttccacgacggcaatgaatgttttcagttccccgtaatacaaaaagcatcgcccctaatcattatttttcctaatcgtttagatcatataaatatattttactaatgattaagaccgcagtaaagtggagttatcaagataatgggaagtgactgagatgaagatgataaagggtatttcagttaccgcaggaattgcgtttgcggctttctatgtcagccgcctgccgtttttgcatatgctcggaatgcttgtccttgccatgctgatcggcatgctctggcgcgccgtattcggacagcgggcggcattagagccggggatcgcgttctcaagcaaatacttgctgaaagcaggcatcatcctgcttggcatgagactgaatctggcggatatctatcatgcgggctggcacgtatttgcaattgccgtctgctgtatgatgtttgcgggtgccgttgtatacggactgtcccggctgttccgtatagatcagacactcagcacgctgacagcctgcggcacagcgatctgcggggcggctgccattgccgcgatcgcgccgcagatcagatcaaatgaaaatgcagccgccatcagcgcggccgccgtttcgttattaggaaccgtttttactgttgtatattctcttgcttatcatggattggggttttctcctgcggcttacggggccttttgcggggcaacgcttcacgaagtggcgcatgcggcggcggccggcagcgccggaggaaaagcagccgtcgagatggcggtgatcgtcaaactgacccgggtcgcgctgctcgtcccggccgcattcatgctcggaatgcgggcgcgccgcagcggaaagtcaaagacggcttctgccgcttcgctccccatcccttggtttatcttcggatttctcggaatgagcgccatccatacatcaggcgttatttcagcttcgttttccgcgtttcttgttcaagtgtcttatgttttaatcggcatggcgatggcgggtctcggtttgaaagtccatatatcggcgtttcgtcatagcggctggcgggcgctcgcagcaggcttgatcggttctctctgtttgtccctgttcggctgggccgcagtgacattctttctataaaaaaagccggtcctcgtaaagaccggcttttgcggattacagcgcttgagcagccgtaattaacgcaagattgtagacgtcttccgcattacatcctctggaaagatcgtttacaggcatattcaatccttgcagaatcggtccgaccgcttcaaagccgcctaagcgctgagcgattttgtagccgatgtttcctgcttcaaggcttgggaatacaaatacattcgcgtctcctttaatgtcggagtccggcgcttttttctccgcgacagacggcacaaatgcagcgtcgaattggaattcgccgtcaagcgtaagctcaggcgctttttccttcgcaattttcacggcttcagccactttgtccgtctcgtctgatttcgccgatccttttgtagagaagctgagcatggcaacgcgcgggtcaatgtcaaacatttgagccgtattggcgctttcaatggcgatttcggcaaggtcctggctgtcaggagcaatgttgatcgcgcaatcagcgaacacatactgctcgtcaccgcgggccatgatgaagacgcctgatgtttttttcacgccttcttttgttttgatgatttgcagtgcagggcgcaccgtatcggctgtagaatgtgcggctccgctgacaagtccgtccgcgagacctttgtacacaagcatcgtgccgaaatagttttcgtccagcaaagctttgcgggcctgttcttccgtcgctttgcctttgcggcgttctacgaaagcctgaacgagttcttccatgccttcatatgtatgcgggtcaaaaatgtccacgccgtcaagcgtaagatttaattctttcgcttttgcttgaatgtcttctttattgccgactacgatcggctttaataccttgttgcccgccaagttgttgaccgcaaccaggatacgttcgtccaacccttcaggaaatacgattttcacatcttttcctgcgactttttcttgtacttttgtaaataaatctgccacgatattccctcctctatgttgacaaaaaacgcttacttttacagcatactcttcttccagctaaattcaaataaccaacttctattatagcgctttcaaaaagaaatcttatttttctaactaatttaattgacggtttgtttcacggcttagtttctgacacaaggcttcggattattcaaggtttctccacagccgaaacggttaaactgtgatatagtgaaggcatcaatgtaatgaaaagatataggagtgaagatacatgagtgagcagcaaaaaacgaacgaagccgcccaaacacttgacggctggtacgcgcttcacgatttccgcacaatggactggacgtcatggaagatgttatccagcgatgagcgcctgtcgattattcacgaatttacgggactgcttgaaaaatggggcgtcgcccaaaaagaaggcaaaggctcgcaaaccatctacagcatcgtcggacagaaagctgatttcatgctgatgattcttcgcccgacaatggaagagctgaacgaaatcgagcttgaatttaacaaatcaaagcttgctgaatttacgatcccggcttactcttacgtgtccgtggttgagctgagcaactacctcgcaagcggagaaggcgatccgtatgaaaacccgcatgtccgcgcacgcctgtatcctgagctgccggaagcgaaatacgtctgcttctatccgatggataaaagaagaagcggcaacgacaactggtacatgctttctatggatgaacgcagaaacctgatgagaagccacggcttgatcggacggagctatgccggcaaagtcaaacagattatcacggggtctgtcggttttgacgattacgaatggggcgtcacgctcttcagcgatgatgtgcttcagttcaaaaaacttgtttatgaaatgcgctttgatgaagtcagcgcgcgctacggagaattcggttcattttttgtcggaaaccgcttgtctcttgacacgcttccgaagtttttgcacgtgtaacacccacccgcctgtccggcgggttttttctttgtcagaatttaaataaaatttgctatttttatcatttttttttacgatgtaaaggagattccattttggtaaaggggtgcagacagttgtcaaaacgaaccgcatttattatgggagccagccaggggatcggcaaagcgatcgctctgaaactggcggacaatggctttcataccgtcattaattcacgagttcccgaaaatatcgaatcggtaaaagaagagatcctcgccaaacatccggatgcgggcgtcaccgttctggccggcgatatgtcggaccagaaggcgagagccggcatttttgaagagatcagatcacaatgcggacggcttgatgtattgatcaacaacattccgggcggctcgccggatacctttgaaagctgcgatatagaggatatgacaaatacctttacgaataaaacgatcgcctatatcgactctatgaaaacggccgcagcgatcatgaaacagcacgaattcggcagaatcattaatatcgtcggaaacctatggaaagaacccggcgccaatatgtttaccaacagcatgatgaacgccgctttaattaatgccagcaaaaacatcgccattcagcttgcgccttttcacattactgtcaactgtctgaatcccggatttatcgccacagaccgttatcaccaattcgtaaagaatgtcatgaagcaaaacggcatttctaaagcggaagcggaggaacggattgcctcaggcgtcccgatgaagcgtgtcggaactgcggaagaaaccgcggcgctggctgcctttcttgcctctgaagaagcctcctatattaccggacagcaagtgtcagccgacggcggcagcatgaaaagcatataataaaaacatcccgctctcagcgggatgtttcttgtaatgaaggaaaggacaaacctagcttttgaatccgcagcacgaattcccttaaatcgccctgttttgccaccattgatattctgacataacgctttccgccgctgccgaaaatctcgccgggcgtcacgacaacatgggcatgctccagcagatagtccgaaaactggtgtgaagactcgaattcattcggaatttcagcccagacataaaaagtccctttcggtttttcaatgctccagcctaattccttttcacataacgccgtgaaaaaatcaatccgttctttatatgtgcgcttcagacgctccgtatgctcaggatttcctgacagcgccgccgctgccgcctgctgaaggccgccgaacatgccgacgaagacgtgatcctgaaactcattgaccgcctgaatgattttctcattccccacggcaaatgccattctccagcctgccatattgaaggttttcgaaaatgaataaagctccgcgccgaccgttttcgcttctttcgcctgaagaaagctggccgggttctgatcaaattcgaacgcgccgtatgcaaaatcgtgaataagatggatgtcatatttttttgcaaacgcagccgctttttcataaaacgcctgatccgcagtcgcgcccgtcgggttattcgggtaattcaaaaacatcagcttggcttttttcaggacggcgggatcaatccgctcaaaatccggcagatagccgttttccggatgaagcggcatctcatgcagctccgctctggccattgtgattcccgataaatactcagggtagccggggttcgggactaaggcgatatcgccggggttcagcaggcattgcgtcaaaacgtacaaacctgctttccctccgccgaacagcgcgacttctgtctccggattgaccgataccccgtactctctctcataaaattccgcgatggcttctttcagaaacggatagcctctgaaagggccgtatccgtgatatgaaggattcagcgcagcttcccgcaatgcttcaacgatatgcggcggagtggggagatcgggattcccctggccgagattaataatctgggctcccgttttctccatctcttttaccttttgaaaaacgagcgaaaattcctgtttcggaagtgtcttgatgacatcggacggtatgatttccatctggaaggctccttataaatggatttgctctgattcgttattccgttctgaaaaggatttattgaccagttttgtatgcagaaacagcccgctgaccaaaaggacgataaacgccatgatgactgccgcgtctacaatgttgatcagcatggaaccggcggcgatgcacaatccgatggacgcctccgccaccgaaaagatccggccctgaatctggttcgcagcgttctcctgaactttgacctttgccagcacttcaccgtattccattgcgataaagaaaagaatggcggcaatgactgacacggcgaaaatcggggtaaacaaaaacagcgcaagcgagacgatcgataacactgtaaaatacatcagccctttattgttgttaaagccccatttgctgacaagagcggcgccgataaagccgccgaagccgatacagaacgtcaggatgaaattgccgatttccccgtcgcctaaaaagcggctgacaatcgggaaatagctgtagacgacaccccacaaaagcgccatcgtaatcatcgtgaacatggcgtttaacacaaaagcatttgttttgatttccttcaggccttctttaaacgactgaaaagcttctcttacgttttctgactgaatcggcacgtattgaagcttaatgcggctgatgaaaaacgcggagacaagataggtcaccccgttaaacgcgacggcaagctccacagaaccgcctaacagaaaaagtccgccggctgcagcgccgacaataatcgaaatcgtcgtggcttttgcaaacaaagtgttgatatttttaatatccgcttctaaagacgacatgaccgcgagacgtgccgggttaaaaaacacgccgcttccgtacgagacaaacagcagcgccagaaaaagcagcggatattcgcctttcgggagaaatgtcagccccaaaaagatgacacctctgatcacatccgtccacagcatgattttcaccctgtcgagcctgtccacgagcacgcctaaaaacggctgaaacaccatcggaatgctgcggaccgcgataacgccggacgtcacccagtagtcatgatagtatgtagacaaaatgagcagggccgggagaacgcaatagtctcccataaacgaaagcgcctgcccgaaaagcaaatacttcgagttcggtttcagctgtttcataccggtaacgcatactttgcagtcagcttcgcctgctgctgaatttgtttgattgattcggccacgtcacccgaattgcttcctttcagctcaaacgccgcaatgctgttgaacgcttcgaacagccgcagatccacggatgtacccgcctcggcagccgagaaagaaacgagttcggtgtctccctttaagacgccgtcgggaatgtcaatgctttcaatgacgaaatcgacagctgtctcaggcagctggccgttctctttgaaatgctgaggatacaagtggcagtcggcgacataacatggctcctgctccaataatcctttcggcagatcggcttcttttccgaaacagagaacatccaataacagctgcgccatgtcgacgccgaagacctttttaatattcggaatcatgttccagcccgcaaatcgcgccgctgattcaatcagtccggcttcccggtttttcattaatttaatttctgtatgtgtcgcgcagttttcgaggccgagtccttcattcgcctttttggcagcttcgacaattttccgctttgcgtcatcatccaggatggacggcgtaatatgcgatgtctccgtgaatccgatttgcggtgttttatcatgaatcgccacagggaagtattccccgtcggccatgatgccttctatgctgatatagtcggaataaccgcttgtttcgtaccagtcgtcatactcgccctgcaaaaattcttccgcgataaaaggcgcttcaaacgtgaccgctttcggtacgttaatcgacttcaggtattcattgactttgttaaattctgcttctgccgtttccctctctttgatgagcgtcacgccgatggagctcgccagatatgtaggcttcagaataagcggcgttccgatttcctgaagcgcggcgcggaaatcttccagcgtcgtcacccgtttatttttgatagacttgacgccggcccggttgaaggcggctctcattttgtttttatctctggcattttcagcggcctgtacgcccgctccccgcaggccgagacgttcacacgcttttgccatcggagcgataaacagttcattgttggtcgtaatggcgtcaaccgcgaacatgtcagccaccttgacgatttcttcgacgacttcttcctcaggtttgtcatgatcttcatgagcccagtaaatcgaatcgggatgctcaaaatcagccagactcttaaaatagtctttatctttaatgaccgcaatcgagtatttttcaattaatgccgcatgagaggctgtaattgcaaaaggtctcggaataaagctgacgaggttgtatttttcggctgcgcttttgtaaaacatatgcggcgggcatcccccaaggtcagcgataaccaatactgtttttctctccatatgtaaacactccttctctattgtgcggtgtatccaccgtctgcggtgatcgcgcttccggtcatatagcttgataaatccgaagcgagaaacagcatgacgttcgctatttcttcaggcttgccgagtctcagcagcggattgactttcgctttttcttttttgatttcttcaagcgtgccttcgttgttttcaaggaacgacttttcattcaaaggtgtgtcaatgattcccgggcacacgcaattgacgcggatgttgtgtttggcgtaatcgacggccatcgaacgcgtcagctgcagtacgccgcctttagaggcgttatatgcgggaatgtcgggccatgcgacgactcctccgacggagcacgtgttaatgatattgcccttgccgcttttgagcatatacttgagcgcgtgcttgctcataagaaacatgcccgtcagattgacgttgagcactttgtcccaatcgctcagctccatctcatgaatcggggcgacaatttcgatgccggcgttattgattaacacatccaatccgccgaacttgtcaaccgctgaccggatggcgttttgacatgccggttcatctgtaatatccgtctgcacaaaatgcagcctgtcattgttttctttccggatcatcgcttctccctgcgcctcatcaatatccgcgacgaccacattcgcctcttgattcagaaacgcctgaaccgcggcataaccgatgcctgatgcgccccctgtgatgaggaccgttttatccgtcaggttcatgactctttcgcctctaattttttcgcttttgctctgttatagcgcggagggaaaaagatattgactgattttgaatctttttcaaatctgttgatggcgccgtgatcttctctcggatcgcagaaataagctgtaccgaatgtcatatccactttgcagccttcaatggtcatatcatagccaccgccgatgcagatgccgatctgttcattgcggtgtttatggaacggcatttctcctccgttgcccggaatgttggcaagcatgatttccacccagtcttccacgaagaacgtgacttccatcccaggcaataagtctctcgttttaaaaatattcaaaaaataatcctcagggcttgtataggtttcaccggctttcaggcgtttaatatcaatggcgatcacttctagatccgtctcatttcttgcgccgtgaggcacgttaggaggcgcgatataggctgattccagcgctgtcatctttcttgtgacatctccgacagtcatggacagctcgccggaaacgacaaggccgatttggacttccttatgctgatgcggttccacgtttgtatgcggcggaacgtaagaaagcagaacttccgtatcgcctctgacggacgaatattgtcttactccgttatcccattctattaatttaggcgtcgggaaataaagttcctgcaaatcttgttcagttttcatcatgaatctctccttttccgaataatgaccagctcatgggaatgcttttaaatgttttgacaaagtgaaggccgtacttttgtctggccagctcatttgtcagcgcgatgtcggacaaaccgtccttcactcttttcgcggctgcgctcgttgagttcaccagatcaaacgtgacatctttacgggtaaaatacttaatcaaattgataggagacgggtgggatacgatgacagtcttatcaagcatgtcatccgtatattcaaaaccgggccggacagccaggccgtacatcggggtgtcgcacctgaaaatttgcagaagctgcagatccggtctcatgtagaagtgcttaatgccgtcatacgcgtgaggcacaattgtgtattccagcggactttgaagcgttttttcaatgcacgattcaaatgtatcatgcaatgataatttgctgttcaccccttggagaagggtgaaattggtgatgaagttttttgctgcgtactcactgcttgtcccttcaggaccgagcgtgttgatcgtaatcagtttagatattgaataagccttgctttttgtttgaatgctattatccaatataatcatgagcaccaaccaatctgttaaattttaagtaaatattatccatagacgttcaagctgtcaatattatttgaaaatattgataattattcctatatattagaaaacaccttataatataaggtgttaaaaatttacatttacaaaattatagaaactttattttaccgatacaatgattggtcggtcttatgctcatattttccataccttctgtatgcgaaaacgctgaggacaaagccgatgagggtgacggccgcacagataaatccgacagctgcatatccatatccgacatagaccggacccatgacagcagaacccaaggtgacggccaaattggacgccagactgtaaaatgccatgattttgccccggcggctctgtgagcaatcacttaaaatagtgctgagcaaggtcaccgtcaggctttgcatcaatccccagacgaataacccgatgaccaaaaacggcattgatgacggcgcataggcgagacaggaaagccatatgctgatcacggccaatgccgcgatcaaagagcgcattttccccgccttatctgcgatttttccggtgaacacgctcatggaaaaaccgattccgtacaccatgatcagcagccctgaagctgtattcccacccggcagcacgcggtgaagatatgtgccgagaaaggaatacatgccgtaaaaaccgatcatgttgcaaaaagtgatcgtgagatatacagggacacggggcaccttcagcgcatcccggaaagtgcctgcctgccgtccgttttcctcttctgttttattcccatccgccgtgctgcggcgcgcctcaatgaaaatgagcgaagcaacgaggacagacatgagggcgaaaatccaaaacgtccaccgccaattcaaaacgccgccgataaaagagccgatcggaacgccgaaaatcaaagcgagcgaccagcttgacacgatcagacccatcaccttgccgcggtacgcataaggcacacggtcgccgaccaccgcatatgctgtcggcacaaacgcacccgccgcaagcccggaaagcgccctgcccagaaagaagaaaaagagattgtgcgccagcgcgcagatcaccgtgccggccgtaaatataagcagtcccgccagcagactgagttcccgggaatatttatctcccagcggaacgagaagcggcgccccgataaaaatcatcactccgtaaatactgatggaaagcgccagcacactgacatccgagctgaaagcccgcgctaaatccggaagcagcggagaaatcaccagctcttcagaacccgcggcaaatacgcctaatgtcaaagcaagcgcgagacagaccggaaatcggcgtttcgtttcgatgtgatcggtttgtttgctgttcatgctctttgaacacctcttccgtaaaacttttctatcttttgttgttttatagtttagcatccttatatttcattttacatttcacatgaaaactaattctgattttttatttacattcagatttttaaataaaatatttagtttatattcaataaatgatataaaatacgccgtctggttatgctatagtgatagaatcatttgttaaggtgggggtcatgaaatgaataacgctgattcaaaggccgcccgcgcaggcctcggcatggtactgattctcgggacgctcgcttcattcgggccgctttcgctcgatatgtatctgcccgctttgcctgaagtggcggccgatcttcatacgacagcgtcacttgcgcagctgagcctgacgttttgtcttttgggtctggctgtcgggcagatcgttgtcgggccgctcagtgatatgatcgggcgccggaagccgctgattctgtcattgctgctttatacgctgtcttctttattatgcgccttcagcccttctgtttcgtttttaattgtcatgaggtttattcaaggtttcaccggggcggccggaatcgtcatcgcacgggcttccgcacgcgatatgtattccggaaaagaattgacggcttttttctcattactgatgctcgtcaatggggcggcgccgattttagcgccgattacagggggatttatccttcagttcgccggctggaaaatcgtatttatcgtgctggcggtaatcggctgtatcatttctgccgccgtgcttacggtgttgcctgaatcactcccgccggaaaagcggacaagcggcggactccgggagacgctgatgacgtttcgcggcctgcttggcgaccggatgtttatgggatttgcgctcagccaggcatttgtgatgaccggcatgttcgcatatattgccgggtcgccgtttatactgcaaaacatctacggcgtatcggcccaaatgttcagcctgctgttcgccgtaaacggtgcgggaatcatatgcgccacccaaatcaccggacggatggccaaaacacatgatgaacggaagctgtttgtctccggtctgatgattgccgtcatcgggagcatcgctttgcttttatcacttgcgtttggtttaggcctggcggcagtctgcatttctttattcatcattgtttcttctgtcgggatcgtcacgacgacgggattttctttggctatgcagaaacaggagaaaggcgcgggaagcgctgcggctcttctcggactcctgccctttatcggcggtgcggctgccgctccccttgtcggtattgccggagaagaaaatgcctggccgatggccgtcagcattttcggttttcagttctgtgccgttctatcctatgttctgtcggccaaacgaaacacaaagtaaagcccgccgctttaagcgaagggctttttttcttatccggcagcgcctttttccgaagaagccggctcacgcttcaggcgttttttgataccgaagtgataatacgcgtaacagatgatcatcagcgggacaccgcagtacagaccgatacgctggtcggggataaagatgagactgattaagataagaccgtaaaccgaaaatccgagaatcggcacgatcggataaagaggcgttttaaatgccaggtccttcagatttcctccttcagcgagaaagcgtctccggaaaacgaattgtgaagcgcagattgacatccacgcgacgacggtaatcataccggagatggaaatgagccacacatacaccgtttcagccgcgactacacttgtcagcagggataaaccggagatggcgatggtgatgaaaagagctttcagaggcacgccttttttcgtcagtttcgttaaggaagcggggcccatcttagtttttgacagggaccacatcattctggacgaagcgtacagcccggaattcgccaccgacagcatggcggtcagaatgacaaagttcatgatatcagccgcataaggaacgccgattttatccagcacagccacaaacgggctttcgatgacgcctgccgtttgatacggcaaaatggacacgagaacaaacatcgccagcacgaagaaaaaaagcgtccgccatatgacgtttcggatcgagcggggaagcgtcttttccggattttcgctttctcccgaggcgattccgaccagttcggtaccctggaatgaaaaattcaccataacaagggtaaacagcacggcttgggcgccgttcggaaaaagccctttgtccgtcgtaaagtttgacagatacggagccgtctgcccgccgttaaaaccgacaaagccgaataccgcagcgcagccgagaataataaacaatacaatggccatgaccttaatgctggaaaaccaaaattccatttccgcaaaactccgcgcagacagcgcgttaatggaaaaaatgacgacgccaaataccaggcaccacacccaaatcggaacggccggaaaccatcgctgcattaaaatccccgccgacgtcagctcaagccccactgtattggcccagctgaatgcgtacatccatccgatcgtaaatcccgtcgacggcccgagaaactttgcggcatacgcctgaaatgatcctgcgaccggcatggcaaccgcgagctcccccaaacaaagcatcaccaggtacattaaaaatccgccgatcacataagccaatatcgcgccgatcggtcccgcttcactgatcgtaaaaccggagcccagaaaaagccccgtcccgatcacgccgccgagggcgatcataaacaaatgccggcccttcatcgtgcgctgcaattcattttgattggtatctccctgcatatacatccccttattccgttatgtcagccatttgtgcgtatgtctaatcggcagctgtgcaaaaggtgcattgtcgtctgctgaatgagttccggcagcacatggaatgtgtacggtttgtacacgcgttccgtccatttatggccgtcctttccgtatacccctatattgaccgacggaatattcaattccctgatttcattaaaaggaatcgtcccgatgacatcccagcccggaaaattatcggtaaaggcggagacctcctcatctgtttcatgcagcgataaaaagcttccgtccgccaaataagggaaaaactttttaaagacgaatgtttctccggttgatgccgctgttttatcgaccgcttcttgaatgacatgctgcaaaagccggtcccgtgtgctttcttccttcagataattgtgcggaaggtaaggcggcgcatagaaaataatgaccttggctccctgctcaggatcgagtttttgcagttcttcgacggctttaaaacatctcatccgcagttcaagatgttcatatgttttaaatgcctgcccgatacactgtgcagggtctatcccgcggcttctcagccttttcaggtaatcttccagactgtacacttgaacgttccatgacatctcttttttcggcaggctcgttctctcacagtattcgtcgtaataatcagataatttttgttctgtctctttgcaggcttcgtcagccacggcggtcagctgatccatgacttctttggcggttttctcgtaaataaaataattaaaatagacatagctgctgacggcggtctgcacgttatacgcttccttattgtcacgctggtagaggcaggtcggcggaagcacaagctccccttcaatgttttccgccatatgaatattgttgtgaattcttctggtgatttctgacgcgatcaaattcggatcgatgccggacagcgtatctccgacatgcacctcccgcccgtaaatcgcaaagcaaggcaaaagcttccctgccgcgcccgtgtatatgtaccttgtcgtgtcaccctcatacagcggcgtgataaaatcgttattaatcgctgctaaataacgaagctgcttttcttgtttcagccgttttaattcagaaatgctggttaaaatgccggaatgctggctttcttcatccgggtttgccatgaacagaatatggcccggcagctgatcgcgccgttcagaaaagtgaagcagattggcgagatgaacggcaataccgctctgcatatcaaccgaaccccttccgaacatccactcgcctgagcgggcgtcccgctgcacatcccgatcaaattcatagtttgagaaatattccgcgagacggtcggaatcaaaagcgatatcttttaaagggccgaaatcctcgatgccgaccgtatcaagatgagcgtgataaatgaccgtattcaggctttcgccgtttccctcaataaatgcgaaaatatttttgcggccgtaagggtcctcaggaatcgcctgctcccacacatgtgacggattctcctgaaagtagggaaagctcttgatcatatctttgatatagtcggctttttttccttctcccaatgtgccgttgatgctgtttaacgccaccagtgatttcgtaatggcttctattttctcctccggaagcattttgctgagctgctgatacatgttccatcccccttaccctcatatagagaaaatagcgcgactctctttttcatcgcgctatttccgaaagattaataggcttcagacgttgtttttgcctgcatatgaagaatcagatagtcaggtcctccggcttttgaatcggttcctgacatattgaagccgccgaacggctggtatccgacaatcgctcccgtacagccgcggttgaagtatagatttcccacgtgaaaatcttcgcgggcgcgttcaatgtgcgcgcgggttttcgataacagagcgcccgtcagtccgtaatcggtattattggcaatctcaagcatatggtcgaaatcacgggcttttgagatcgcaacgaccggcccgaaaatttcctcctgcatcaggcgggcgttttcatcaacatccgcaaaaatggtcggctgaataaagtatccttttgaatcatcaccttcgcctcccgtcaggagttttccttctgttttgccgatttcgatataactcatgactttattataagatgcttcgtggatgactggccccatgtatgtatcaaaatcttccggacttccgacggtgagtgattttgttaaagcgacggctttttcaacaacttcatcatagacgtcctgatgaatgaccgcgcgcgaaccggctgaacatttttggcctgagaatccgaaggcggaatacacgattgaggaagcggcaagatcaagatcagcatctctgtctacaagcaccgtatctttccctcccatttcggcaatgacccgtttcagccacttttggcccggctgtacttttgcggcgcgttcatagatgcggcatccgaccgcgcgggagcctgtaaacgacacaaatctcgtcttcggatgctcaacgagatagtcgccgatttctcctccgtcgcccggtatgaattggagcacgccgtccggcaggcccgcttctttcatcacttctacgaatttcgccgccacgacaggcgccgcatccgccggtttcagcagtatcgtgttgcctgttacgatggcggctgccgccgttccggccataatcgcaagcgggaagttgaatggagaaatgacaattcccaccccaagcggctcatagtgatactgattatattctccgtcacggctctttacaggagaaccgtctttcagcttcagcatctgacgggcgtaatactctaaaaagtcgatcgcttccgccgtatccgcatccgcttccttccacggtttccccgcttctttcaccaggtacgcggagaattcgtgctttcttctgcggatgatcgccgccgccttaaacagcacattcgcgcggtgttccggccgtacttttttccatgtttgaaatgcctgcagcgcagcctgcatggccttttccgcaagttcttttccggctgccgatacagaaccgatcacttcttttttatctgccggattgacggaaatgatctttttatccgtttcaatcgcttcaccgttgatgataagcggataatgcttgccgagctgtgaattcacataagccagcgcttcctgaaacgattgtttatttgtctcttcctgaaaatttgtaaatggttcgtgtgcgtatgaaactgtcattagaattcctccccgtattttgtaatgtgtgctcacgcttaatgaagatgcaagaagcataccagcatagcaatttgtgataaaaataggaaaatctttgccgaaagcggacgaagcttgtccgaacctgtcagctgcaatctgaaaacgcaaagaaattttgcgatccgctatataactgatgcaaaatctctttgcggataacacttatacccagccgcggaaccgggccgcttcagccgactttctgatgcccgtcatataggcggccaaacgcatatcgactttgtgggtatgcgctgtctgataaatggattcaaacgaattcaccatgacgctgcgcagttttccggcgacttcttcctcagaccagtaaaagccttgattattttgcacccattcaaaataagacaccgtcacgccgccggcacttgccaaaatgtccggcacgagaagcacgcctctttcattcaggattttcgtggcgtctatcgttgtcgggccgttcgccgcctccacaatgattgaggctttaatgtgatgggcgttttcagccgttatctgattggagattgcggcaggcacgagaatatcacagtccttttccagcagctcccggttcgttatgacatcagagaagagattcgtcaccgtgccgaagctgtcccgcttatccagcaggtaatcaatgtcaaggccgtcagggtcatacaaagccccgtgggcgtctgagatgccgatcaccttggcgccggcgtcatgcataaatttagcgagaaagctccccgcgtttccgaacccctgaatgatgatccgcgcattttccaacggaatcccttttttcttaacggcttcctcaatacaaatcgtgacaccttgcgcggtcgccgtctcccgcccctgtgaaccgccgagaacaatcggtttgcccgtaatgaatcccggtgaatcaaattctctcaggcggctgtattcgtccatcatccatgccataatctgcgagttggtatatacgtcgggagccggaatatcctttgtcgggccgacgatctggctgatcgcgcgcacatatccgcggctcagccgttccagctctccgaatgacatcgtccgcggatcacagatgatgccgccttttccgcccccgtaaggaagatttgtgatgccgcattttaaagtcatccagatggaaagcgccttaacctcttcttcactgacttccgggtgaaaccgcacgcccccttttgtcgggccgactgcgtcattatgctgtgagcggtagcccgtgaaaacctgtactgagccattgtccattttgacggggatgcgtacggtcaaaagccgcatcggctctttcatcagttcatacatattgtcaggatagcccagtttgcgcagggcttcttttatgatcgattgtgtggacaagaacaaattaagaacttctttttcttcatctttctgagtgcttttagaaagcgggttggctgacatgttttatcacctcatcgtattttacgtgtaagcttcaattaccggcagaacgaaatgtaagcgcttttacaccaaaacccatcaatccctttcacattgtcgttacacccctttttatatgcaagattcatgccaggattttgcgcataaaaaaagaggctgttgtcagcctctttcatcccggattaacgcgggtcaataaccagctttgtttcggcgtagagactgccggcccccaaaccgtttacgtaatcgcctttaattgtatacgtgcccgcgcgcggaaggtttttacgcaccaggacgagattgtattcagacgcgcccaataagtcaagggtaagcggaagtctgaccgtttttccgtagttgagaatttgcgtttctttcagtgttcttccgtttacagagtccctcacagtggcgttgaacccgtcaggaaattgaaattcaacggcgccgacggcaagcagcgcattcggcttgtatgtgacttcaatatcagacgtcgcgtattctttcgtactattgacggttttcgcttcaataacggcagattgggcgttcgcatgaaaagatggcaagaacacagctgaaaataccgcagcactgatgagaaaggcagaaaatgattttctttttaacatcatgaattcctccagatcatataggattcagagcgtcctctgccggaaaagcgtgtctgatgattccattcgcgaattgggtttctcttttcctgagaataatctaccacctttatccatggaagtaaattattttttggaatattcaatcatttatttttcacgagatgaaccagcacaaaaaacgaagacatccgctgtcttcgtcttgtgcgctaccgatgagccgtctgccagtcaaatccgatgctctcatcattccacgggattcttttttcgtcaggctgatccggattgtaggacattgtcgtgaaataaataatggtcagcggggtttcgcccagcactctgtacccgtgtgcgacgcctttgggaatgagaaggagcatcggattgtcttctcccatgtagtagacatccgtttctcccttggttgccgactcttcgcgaaggtcatgcagcacgacctgggcgtggcccgtcgggaaaaaccacaggtcatcctgtttctcatgatagtgaaacgctttaatgacgccgggatagcttttggaccaggaagcctgcccgaaacgctctaagagatgttcatcgtcacggacgagttctgagaaaaaaccccggtcatcgctgtgtttgatcagctttttaatttttacgccttcgatcacttgcactgtccctccctttgtaaataatcctttagcgcttcccgccaatgcctcatgccgagcccctgccgttcaatcgactcaagactcaacaccgagtaagcggggcgcggcgtctcatttccgtattcctccgtcgtgacgggcagcacggcggcggttctgccgctttcttcaaaaatagccttggcaaattcataccagctgcacactccgctgtttgcggcgtggtacaagcccggcggcctgtcaaacagaccgatcaccgtttcggctaaatcctttgtgtacgtcggcgctccgacttgatcgttaacgacacgaacctgatcatgtgtatccgcaagtttcagcatcgtattgacaaagttgtgcccgccgctgccgtacacccacgacgttctgataatggtgtggttttttcccgttaaccggatcagttcttcgccgagttttttgctttttccgtaaatcgtgcccggatctgcgggatcatcggtctggtatggccgtgttcctttgccgctgaagacgtaatcggtgctgatgtgaatgaatttcgcgccggtgttttcagcctcaagcgcggcataataagcgccgattccgtttattaaatacgctttgtcgagctccgtttcacatttgtcaacggaggtgtatgccgccgtattgacgacgatatccggcttgtaatggctgaacgagtgccgcaccgaacgctggtcggatatgttcatcatcgcttttgtcaaggcgatcacttcatacccttcccgcttcagctggcggcataactcccgccccagctgaccggccgctccggttactaataccttcgtcaatcggatccccttctttccgattagtcttggctgtctgtataccagcgaatggttcttctcattccttcttcaaatgtgacgtcctgccgccatcccagctcatttttcagctttgaagcattgatggcgtaacggcggtcatgcccttttctgtcttcgacatgagcaaaccgttcctcgacaccgagctccttcatgataaatgacgcaagctctttattcgtccgttcatttcctccgccgatattgtaaatttcgcctagtgttcctttttccagcacgagcttaatggcgcggcaatgatcttcggcaaacagccagtctctgatctgcatcccgtcgccgtacagcggaaccggcgtgccgtttacggcatgcctgataatggtcggaatcattttctcgtggtgctggtacggcccgtaattgttgctgcatctcgtaatgatggcaggaagcttatgggttttcacataagacatgacaagcaggtctgagcttgccttgctggcggaatacggattgttcggagaaagcggcgtcgtctctgtaaaagcgggatcatccggcgccaaatctccgtacacctcatctgtggaaatgtgaatcagcctgccggcttttccctgtaacaccgcgtcggccagtcggtatgtgcccatcacatttgttgtgatgaacggctctgcctgatttatgcttctgtccacatgggattcagccgcaaaatgaatgacagcgtcatacatttgggaaaagactttgtcaatgtcctctttttcagaaatgtcacctttgataaaacggaaacggccgttcttttttaaggcttctatttcaagcggcctgcttgcatacgtgagattatccaggacggtaatctgcgcatctgtttctttcagcatcatctttgtgaaggtaaggccgataaatccggcgccccctgtaattaaatatgattttggcatgattaatgctcctgtcctttctgtaatgcctgatgcgccaggcttccggcgagatagagcgattcatgcgtgcccgcatccacccaccagcccgttaacacatcatacgtcagctcactgtgttcaatgtataaattattgacatccgtaatttccagttcgccgcgttttgaaggagaaatttgttcaatataagaaaacacttctgcgtcgtacatgtagatccccgtgacgcatagtctggtcggcggctgctccggcttttcaatgatcgacttgatccgtttgttttcctcatcaatctcggcgatgccgaagcgctccggatcgtcaacttctttcagcagcactttcgctccttttccctgctttgcgaaacgctccgtataaggttttaatgaatcttcaaaaatattatctcccaaaagcagaacgaacggatcgcgcccggtaaaccgctttgcgtatgataaaccgtcggaaatgccggatgcggctggctgaacctgatatgtgattgagacgccgagctcttctccggtttcgagaagtttatgaaattgcggaatatattctttttgcgtaatcagcaagatatccgtaatccccgcttcttccagcttcatgatcgaccagtaaatcatcggatatggaccgacagggagtaaatgcttattgaccgcttttgtcagcggcataaggcgtgagccggtgcctccggctaagataacacctttcacatgaacacttccttacgtgtggttttatcacaaatcataaagaatcgccgccgcccgtttaatgcccctgccgtcaaccagcggctttccgttctgatgaagcccgagccgtctcggataatcagcagccagctcagacatatgccgagcgagcacgtccgccgcggtgtgttctcccaggccgagatgaacggcggcctctcgtgcggcgaatttttccgccgtctcagtttgatgctccacttgagaaagaacgatgcagggcacacctgtacaaatggtctcatataaggtgatcccgccggacacgatggccatatcagccctcgtgagaagcgcggccatgtcatttgtctgccttaccatctcggcataaggcatttgtgtgagatgcgcgcgcacgtcatcagcatgaggcgccgcgccgcccatgacgatgatcactcgtttccgctgaatatcagggatgcggcggcatgcttccatcactttaaagacaagcttcttcgggtcgcttcctcctaaagagaccaatatggttcggcattcttttctcagctgatagagctgctttgctttttcaaaacccggatgaagaatcatataatccgggccttcatataccgcggcgctgcccatttgaaccgtccggcttttcagcccgccgtaaatgccgtttataacggcatcgcataaatgaatgacatgttccctcttttcttcaaataagacgatacgagccgatgaatgctttttgatttcctccagccagtcacacggcatatcgagcagatcgaatatgagaaggtcgggagcccgcgtgtttatttcccggacaataaattccttctgtcccttgtcaggcttgatgatcacttcccattgatcagatgatagataagaagaagcctctttatttgtgtagaacgttattgagcagttgttcttaatggcaccggcaagcagcttcatccgaaccgcgtgccccatgccgatgtcacggcccccgtccgcgaaaatcaaaacccgcacgctaatcagcctctttttgccggatcatttgattaatggccctgagctccggatcacgattcagcagatggatcaattcttttgccggaatatcaggacgcgagcccgcttttacgtacagctcgcgggccagcctgtagtcctcttctgtatcgacggtcatccgcaagtgaggagcccggagttcctgcgggggctcaggaaagagaagccggtacctctcaggggattctcttatcaaaagggtgacatgctcctgatatttgtccgccagcgttttgtccgcattgatctccgttaaaaggcgcgcgttcaccgcctcgccgccgatcccgagcggtgtaccgcagatatacgtgtagtctgcgtgctgatctaaatgcgattgaatcagaaaatcaagcagcgaagggtcgacaaacgggttatcccccgtcagtctgactgcgatgtccggttttacttgttcgatgacttgtgcaaaccggtcaagcacacgctgttcgctgccgcggtggacacggtagcggttgctgaggcagtgcgcagacagaatgtcgtcggtcttgctgtcagacgcggcgacgatcagattatcccgtgattgatcgtaaaacgcactttgacgaacccttttgacaatcatatcgaggatcgtatacccgccgatcggtttcagcactttgccgggaagacgcccgcttcccatccgcgcctgaatgataaacaaaatgtcagtcatcatatgggctgcctttcgtcaaaaggtcatcccaagtgatgcccgtgtcggcggggatatccctgaccgcacgcgcgccgtcagttaaaagctcaaaatatctcgggtgaagcccctgcggtttttggccgggacgaaggacggcaaggttttccgccgtaaaatattcgcctttttgaatcggcgctgttgaaaaaatgcctctgtaagcaaaccttctgatatccccttcaatcggtgtcgtcgttttatgggagcttcccgacagcacttccggcaccggagcgtgatgcccctgccgcagctccgcttcaactgagcggatcgccgcaaccatttcttttaattcatccggattgagggcgaaggagtgatcagcaccgggcaggtttttatcgatcgtaaaatgcttttcaatcagtttcgctccgagcctgacagccgcgcacggcacatcatacggatgggcgctgtgatcggagaaaccgatcacagcatccgggaatgcggcggcaagcatgggaatgacgctcagattgctgtattcaggcggcgcgggatatttcgccacacaatgcatgatcgcaatttctttgttcccctcgccggtaatggtttgataagcctcctgaatatctgaaatatcagcgcccgcggtggaaaagataatcggggtcttcagccccgcgacatatttcaataacggcagatggttcagctcgtaggaggcgattttaaaagctgaaggggaagtcgcatacagtaagtcggcagagccttcgtcacataccgtgcttaaaaacagcacgccttttttcttacaatattcaagcagcggttcgatccactcagcgggcatttccattgattgcaccaaagaaaaaatagagacgttttttcccgcagcggttttgtataagccggggtctttctgatacattttgtcagcctgaaacatttggaacttgaccgcatccgcgccggcctcactggccgcatctatcaattcaaacgcctggctcagttttccgtcatgattaattccggcttcggcgatgatgaatacgggcgaaccttcgccgattgacttcgttccgattttgcatgatgccatcagtccgcctccttcccgggccacacatgatagtagtaaaaggacgcatccgctttaaatcccattctttcatacaggcggatggctcttacattgtggagctgcgttcccgctgatacagtcttatgctgaaagcgcaatgattgttcaatcacgtgcgcagctaaatggaatcccgctccttttccttcaaatcccggctttaccgccatcagatcaaggacgaattcatcgcctttagacagcccctgaacaaagcccgcggtctctcccttatatttggcgaggaattgtaacgaagctctgccttccgcgttattccgcgcccactcttcaaacagacggtttgcacttttatagctgagatgggggtcctgataatacctgctttttgtaaaggcgtcgcgggccagccggctgatcgcttccgtgtcgccgggtccggcttctgtaatctcaaacggcggcgtgctgttatatacacgcaccggactgacgagcttgagaagactccctacaaaataagcgttcggaagcgactgcacgacctgcatcgcgccgatatcttcagctggtattttaataaatataaaatcagtgccgtccgcccgccttgccgcgtaaaattcctgaaacagccttttgagctgtccggtgctgtttgcggctgcaagcttcacattgatgatattttttcggaacaattgactttcccacgaagagttttcatataaaatcacgccttgaaggctgttttcttccaataaacagagcgacgattcataggcttcgggctgaatgcccttctgatgcaggaaggcatgaatcatgtcctgtgcaagattttctctcagtctgtacacctaatcagcccctttgacgatatccgtaacggctgcaatgacgtattcaacgtcatcatctgtcattgacggataaagagggagtgatacggtgcggtgataatacgcggccgcggccggaaaatcagtttccttatatccgtacgttttttgataatacggatggaacggaaccggaataaaatgaacacttgtgccgatattatattggtctttcaaagcggaaatcagatcgttccggctgatcccggcctcctgctcctctatttgaagaacatacagatgccatgcatgccgcccgtcatcactgacatatgggacggtgagccctttcatgtctctgaaagcgtcctggtagcggctagcaatttcagcccttctttgctgcatgctgtcaatccgtttcagctgatgaagcccaagcgctgcctgaagatcaaacatattcattttatagccgggcgtttcgacctcgtagtaccagcttccgtttgaagaatagcggttccacgcgcctttgctcatgccgtgaaggctgagcaccctgatctgatcggcaagcccgtcatcgtccgtcgtcagcatgccgccttcaccggttgccaggttttttgtcgcgtagaagctgaatgccgtcgcatcaccgattgatccgatcattttctgtttataagtggtatacacggcatgtgcggcatcctctaagacaaataactgatgcttttcggcaatggccaaaatttgatccatatcacacgactgcccggcgaaatgaacgggtacaatcgcttttgtccgcggggtgacggccgcctcaattttttcagggtctgcattcagcgtaagcggatcgatgtcagcaaacaccggaacggcgcctgtgtgcacgattgtattggctgttgaactgaacgtcacggcagacgtgatgacctcgtcgccgggaccgatccctttcgctttcagggccaaaaacaaagcggcggtacatgagttcagcgcgatcgcatgctttgcccccgtccaggcggcaaaggctttttcaaacgcctctactttcggtccctttgaaagccagcccgattcaagtgtatcaataacctcctgaatttcgtccttcccgatcatgggcaatgaatagggaagaaaagctgatcttttttgcaccattttttttgcgctcctatcttttttatgaagggtcaacccgtctgaagctgactccggttttttcctgaagcacttgacataaagcggcaagcgaatcctgaaccgggtagttcgcggcgacaaaagcacggcgcgcctgttccgctttttgatattctgcggggctttcgcatatccggattaattcctgagcgagtgcctgcgggtcctcaaaaacaaattctccaagtgaatgataataagggtatcggcgggttcccgctgattttccgatcagcacgggcttttgaaacagcatcgcttcaagaccgaccgttgatgtctgtgtcaccgcagcgtcaacaaacgggagaatatcatacagctccatctcttttttgatgattttgcctgctttatatttccgcagcacctgattgtaagcatccagcttgtttttgccgatttcccacggatgcggtttaataatgagctgcatgttcttttggccggcaagctcttcaagcactcccgtataaaattcatcagaaaacggctgcgtggcgatcagcaccgtccgctgtgacgggagaaaagaaagtttgcggtaaaacgtgtcccgatctatcggctctcttgagaaaatctcgtcgaaacggggatgccccgtgatgatgatttgttcctccctgcagccttttgctttataccactccgcttcataagccccgaatacagcctgatagtccgtaaatacgggcagaaacgcttcatctcccatgagcgccccgtgctgaagacagatgctgacggcgttttttttcgcggacatcagcgccagcacacggctgtaaatatcctccgtcgtgccgactacaacggcggaaatcttctcggccgtaaacaaaatatcaacggcgtcaatcgcttcaataaataacgggatgtctttatacagtcgttcctgaaattctctgtttccgaaagcgggatggctgtgaagctctttcaaaatggaatgggctttttcaatataagggacggggttccctttttgccccattcccgtcagctccaatttgcagataacgggcagcccatgatggtcaggcagactccatctggccagtaccgctgtttttgccggatcaaactgccggtaatttccctcggtgaaccgaagatgatcgaaatgcagaatgacttttccgtttaccggtttctcatctgttttcttaatgttttgccttttttgatcataataaggctgaataccggcttcaggaatatgctgatccgccggaccgaaaagctccgggttctgctccatgctctcccgaagcgccggactgatatattgataaaaattactgatcaatgcgagcgggatgtctttgtagcgaagtgactgaaaaaggtcaatatactgccggtacagcacccaatagttcgctaagtatgccgacaagccctcacccctttccaagcttttttaatgattccctcagctcccggcacgtggtctgctgcggaaggctgttcacaaactcgtttttctccgccgcgaaaagctgataatggatggattgatcggtaatataattgatatcaagttcctcagaaatcgggtaaaacggataaaaatgattcactctccagaaaaaacgggcgtcaccgatacggtaaaacgcggggctttcatcccaataggaaccgaatgccgatttgacctgttccagcacggaaaaccggtgcatgaccgaacaatggtcaatggcgcacggcgcgttccacacgatccgttcggcgggcctggccgtctccttcaccgtctctttccgctgattcagatgataggttttggaacttgaatacacgacggctttttccgggtcttcatcaagctctttcaccattttctcaagccgttccggcacatacgtgttgtcgtcggtcgcatacgtcacgtactcgccctccgccatttctattgcctgattaatcaaggcggcgtagcgtgttttttccgttctttctttgacgcccgatacatcgctttgataaaaccggacgcggtcatccgtgagaaaaggacgtatttccgccaatgtctcttcatttgagttgtcatccataatgaacagctcaaagtccgtaaacgtctgagacagaatacttttaatagagcgggccacatagtcacttttgttatagctcgtcatgatcactgacactttaggcaactcgtcacccccttttcgcacctgaaactaccgctatcatatgttccttatgcggaagatgcgctagggatacagactattatgtgaaaagtcagcattgcgcgcacaaaaaaagccggctctgatatccggaaacattggatcgtattttcttttttcgcataaatctttctttgggctcatatggtggaatagataaaaacagcagccgctctgtcggctgtctgatacttgtcaggaggtttcagcatcaagaggttttcatcaaaggaggaacaatatgaaaccgaaaaagaatcaatatcagcaaatgcaggggatggggatgggaatggatatgcagggattccagccgcagctcgggcctaatccttatccgcagcctcagggccaaggatcacaaatgatgccgatgcagcagcaaatgacaatgccgatgcagcaaggccagcagggcttcggcggggggttccccggccagccgcagcagcagggcggcggcagctttcaaatcccgtcaggtccatcatcgtcacaaaacgttcccggcatgctgccgattgaagagtcatacattgaaaatattctgcggttgaaccggggcaaaacggcgacgatttatatgacattcgaaaacagcaaagaatggaattcaaagattttccgcggtgtgattgaggcggcgggacgtgaccatatcatcatcagcgatccgaaaacgggcacccgctatctgcttctgaccatttaccttgattacatcacatttgatgaggaaatcgcttatacttatccgtactccatgtcttcttattctccgagataaatcaaaaagccaatcgctcacttgacagaggattggctttttttctttataaatatttgacggccgcgacgataatcataatccaagagatgataaacgccacgccgccgagcggtgtaatcgcgccgagaatggaaatctgcgtcacgctcaatacgtacaggcttcctgaaaacagaacgatgcccgcaaacatcagccagcccgcaacagaaacactgcctgcgccagagagcttttcagccaaaaacgcgacagccagaagaccgagcgcgtgatacatatgatattgcacgcctgtgtgccacacctgcaaatatttatcggggattttcccttcaagcccatgcgcgccgaaagcgcccagcgccacggccaataaagcgttaatcgcaccaagaataataaacactttcatctatttttctcccgccttttcgttaaagtttccaattcaatcataacccaacatcggcaaaattcaacgtccgtcatccgatgacacgagattgtcggattttttctttttgataagctggattcggtcaatcgctatcgccagcagcgttccgagcacaaggccgttgcttaagagcgaaatcaggatcggatgcatccctgataacgcgctctccggcacaaacattacgccgacccccgtgaggagcgccagaccgataatggaacggattcgtttttgctccgctttctcataagagtcaaactccgtaaaggcaagacccgccatcgtggagaaaacgacgaagtttaccgcaaagccgaccggtgagggcagactcgcaaacgcattcataaatagcgggatcatactgatgatcatgacaaatacacttcccaaaagaaacggctttttcgaaggaagcttcgtcgtctcaataaaaccggccgcccctgaaatcggcacaggcgcaatgccccctgacagcccgctcaaaaggtggctgatcgaagccgcaaaccctgccggacgctcacgccgtttcccaacggtgccgccgaattttttcaccgccgcttctacaacccggatgctcgcgagcatgttgacaatcaaaagcacggtaatgaagagtgacgtaatgatcaggccgctgtcaaacacgggttttccaaacggaaaaagaaccggcagctgaatcacgcgatccggtatttgaatcggtttggcagcgccgaagacggcgaataagatccatccgccggcaagcgaaaggagaatcgcatactgtcttaagaacgtaacattcgatcgggacatgatgaacatcgccgccgtcacaaccattgcgagcccgaatacaaggccgtcgacgctgttttttaaatagccgatgcccaaaaggcctttcacaatcggctgactcagctgcatgaccaacagcagcagatacacaccggtcacaaccggcgtaaacagcacggccagccgttcaatcactttaaaaaggctgaacaaaaagaaaaagacagcgcttaataacagcgccccctgcagcgcccgcagcgtctcgccgaatgtcgcaaacaccgtgcccgtcagtccgccgtaaatcgtgtatacgccccaccataagcctgccgggctttcattaatcggcagacgatgtccctggagacattggatgaccgcagcgacgccaagcacaaaaaatgtgctctgaatcaatgcggcagaatcggcatggttcaagtgaaatgattgtgcgatggcgacaggaactacaatcgcagccgcaatcataaatgccgtccattgcaaacccccgagtatcagtttcaagtcaatcaacctctcctgttaaaaatcgaaaatggaatccccgtttccgtcttcctcacgttcgtctttcgcttttttctgatattggttcagcccggcgctgcccatcattttttcaagcagcagcgggtctgtcgaaggagacgcggaaggtttcggcgccgctttcggaatcggattctgcacaggcgccggagcggtgtgcgtctgagtgccgagcacgacatcacacagagagcggatggcggccgcgtgcattttgacctcctcggtgcgggtcgccgttttcgcctgcctcagttcttcttccatcttctgaattaaagcagagatatgtatgttcatgagtaaatcctccagcagtaatttgtcttcttcctgcattttatcaaatttctgagcggatcgcagaattgagtttgttattttttctgacggcataccgcccggaacatcaaaaaagacgcttccgccgggcggaagcgcctcaaaaaaccgtttattgcggcaggtcggggatgcaccaatcgatcggctgctcccccattttttcaagggcggcgtttgtacgggaaaacggtctgctcccgaaaaaaccgttccttgccgaaaacgggctcggatgagtcgattcaataataatgtgtttcgatgtgtcaatgcgctcttttttcatctgcgcgtgacgcccccacaggataaagacaatcggcttctctctttcattcaccacatcaatgatgcggtcagtgagccgctcccaccccttgcctttgtgggaattggcctgaccgcggcgaaccgtaagcactgtgtttaacaaaagcactccctgcttcgcccagctgacgagcgatccgtggttcggtacggggcagccgatatcgtcctgaagctctatgaaaatatttttcaaagacggcggctgtctgaccccgggctgaacggaaaaactaagcccgtgcgcctgtcctggcccgtgatacgggtcctgtccgagaatgaccgcttttacatcctcatagggcgtataatgcaaggcgttaaaaatatcatggctgtcaggataaatcgtttggctgctgtattcttgtttcagcatctctctcagctcttgataatacggtttgtcaaattcatctttcagctgattccaccagctgtcttttaaaagctgtttcaaactgtccgtcccccttatgaactgtgcagtcttgaatggacgggctttccgtcccacacaatgtcagtcggcgcctcccgcctcttcatgtccggctcttctagaagaaccgcgaagtttttcgtcgggagctccccaagcccgtgcttttcgcttaaccggtctaagtaccgcttccgtttgccgccgagatccgcggactgattgccgcctccctcaaaaaacgcatatatgacgctcgcgcaaggaacacgcttcacacggtgctgtttcgcggcgcgcaaataaaagtcccagtcccaataattatggacatccggatcaaaataccctaacgtgtcatgcagagaacgtctgtacatgctgcctgacggaacgtacgtggaaaatacccgcatatccgcaaaatccgccgtataggcgaacggctttcgtgacaccgggtatctcgtgccgccccgttcttcaaatgacacaatttccgcgtcagaatggacaaaatccgcatcagcaagtgcagccgtcattctttccaaatggcccggcgtaatgaaatcatcatcatcgcacagcatgatataatcaccccacgcttttttcacacctgcgttccgcgcttccacatgtccggcattctgttctaaatcaataatctgaatcggcagatcgctgtacagctgcttcgcttgttcgaccgattccccggcatcatttacgatgatcacttcataaggctttatggtctgcctggaaatcgactccagcagctcacacaaagccggaatccgattatacgtgactatgacaattgatatattcatgacccgctccttctgctttttctcatgttctattaaaacataaagcggcggagagatcagggggatttttgatttcggcccattcagaaacaaatccacgtcatccccgccagcaaaaccagaatgatcagaaggtctccccaaacagtgcataccgccttggcattaagtctgcccgcctccatggcattccacagttttgattgataaacaggcaccaacaccatcgcatagcatgtgcacaagcagacaaaagccggcgggacaagcgcacatccatcctcatgccaatcatgaatcagttccggtatactcaccccgctgtcaatgtacaagtataatatacccgccagcggaatgagcgagctgacctgcagctcgaaaagtttcaccttccactcacgcgcaaacgaaacagcccaaatccatcccagcgcataaaacaatagaagaagcaaaatactgaaaacaacaaaagtagcgtcttgcatcccattcagaaccataataaaaagactcacaacgggcaaggcaagaaccaagccgcagacggtaaatacggtaacggctatttgggcgcacgcgccgtacatccacgaacctaatctcatataaacacccctatatagattccctatgtatatagtgaaaaagatcaggcaagtctctgcctgcctgcgtaaaaacctattttgccgcaaaacggaaaacataccgtcacaacggcgcatactgccgcaaaactcggtgtgaccgccgaaggaaacagcccagccggaaccagattgaacaaaaagacaaacataaaacatagattcggcaccattgaagcccataccgtccgctcagcaagctttttgccgccagccccgaactctttgccagcttgatagccgatttggaaccaatacagcacataaccgatcataatcagccatactgacacggaaatccctttccacagcgcgtcaactgcgggatgaatcctccacgcgtgcatcatcgtaatcatcgcccccatcacaaaaagaccgcagttgcagaacagataaaagagcataaaagtccgcgcgggcaccgtcgaagctttttgaaaagcagagataatctcagacggagtccccacttcccgcagaataagctccatcgcttcgctttcggttttgcctttttccagatgaacacaaatggcatgatgaatatggctttcgatttcctttaataattcacggcttccggccttgccttccagcccttttctgatttcgtgcacataaaggtctttatccattctgcccgccccgcttcagcatccggtccatcagagcggagaacagattccattccttcgtccgttcggctagaatgttttttccttcatcggtgatccggtaatattttcggtcgggccctttggtctgcttttcccagtaagaagaaatatagctttggcgttcaagcttatgaagcgatgggtacagcgtgccttccttcatttgcagttcattcccgcttcttttctccatttctttcacaagttcatacccgtacatgggccgttcattcagcagcgtcagcaccagaatgaccgtgcttccctttacaagctccctgttgagcatttattttctcacccttacctagtaatcttatgtaggtattgtacgcacatcccccgcggctgtcaaatcattcctccaagccttccgtattgtgatcgggagaaaatctaactataatgagatataaaacactgatggaggccattgatatgtcaatgcacaaagcacttactattgccggttctgattccagcggcggcgcgggaattcaggccgatttaaaaacatttcaagaaaaaaacgtatacggaatgacggctttgaccgtgatcgtagcgatggacccggagaacagctgggatcatcaagtatttccgattgatgccgatacgattcgcgcacagctggcgacgattgttgacggaatcggcgtagacgccatgaaaacgggaatgctccctaccgtggagatcatcgagcttgcggcgaaaacgattaaagaaaaacagctgaagaatgtcgttattgatcctgtcatggtctgcaaaggagcgaacgaagtgctgtatccggagcatgccgaagcgcttcgcacccaattggcgccgctggcaaccgtcatcacgccaaacctgtttgaagcaagccagctgagcggtatggatgaattaaaaacggtggaagacatgaaagaagcggccaagaaaattcacgaactcggcgcgaaatatgtattgattacaggcggcggcaaattgaaacatgaaaaagcgatcgacgtgctgtatgacggagaaaccgcggaagtattagaaagcgaaatgattgatacaccttacacgcacggagccggatgcacattctccgccgccgtgacggcagaactggccaaaggcgctgaagtgaaggaagccatctatgcggcaaaagaatttatcactgcggcaatcaaagaatccttcccgctgaaccaatacatcggaccgactaaacattcggcgatgcgtcttagcggaaaataaaataaatatcccctcatgatcgagggggattatttcatttttttcgcggatgaccgcaaaaacatctcaatcgattgcacaaacagcgcatattccttcatctgttcatatgtatgcctcagccgatcactccattcattgtgcggctcagccctcttgagcatgcgattcagctgaagcaatacttctttatattcttcccgtttatcttccacttgctctgcagctttgacaagtaaacatttcggcgtcatcttctgatttttcaaaactgagaaaacaactccttttattcctggaatcataggctttcgtttgaagaatagcacagatggcataggtttcacataagaaaaaagaacgattttctacaaaagtgtccaaattgaggcatttatttccgttttcccaaccgaagtgacggttacgtcatcatttcccgggaaaggaaaatatctggcgctgaatacctcttctccatcattcaaaaacaattcaatggaggatgcatccagaaagagctggacggaatgcagctcgctgatggcgcagcttctcttttctttttcttctccgctgaaagcggtgcgctccagcacagccagcccctcttcctgatgaaatataaaccgggccgcgccccgaattgagatttcaaaaccggattcgcaagtaatgtcttccagcagcacttcagcccgggacgcatctttcaccgggaggcttacagacgagcaattcaattgaagacggcgcttttgttcatccgtgcggcgcgatttcatttccgggagcgggcgctgtatgattctgccgttggacagtgacagctgtctcggcatcgttaagcagtgaatccagtgatacgcatgtgtcggatgcttgtcctcatgctgatccggaacgcccatccacgcgaacagaatcctccgtcccttatcatcttccagcgtctgcgccgcataaaaatcaaatcctctgtcaagctccgtaaattcaccgtgcttaaattctggcggctctgtatgcagcctgccgaggaaatagcccgcctggtggctgttatgatattttatcccgtcggcttcaagcccctgcggacatacgagcagcacgtcggttccgtcaagagaaaacaggtcgggacattcccacatatagccgaatgacccgagaccgcccgagtccgcccccgcaatcgaaccgagaaacgtccaatccgtcaggttctctgatgtgaacaatacagcgcttccggtgagcttttctgtctgcgcgccgagcaccatgtaatacgctccgtctttcttccaaaccttcggatcacggaaatgagcggtatagccttttgggagacgcacgacgattccttttttttcaaatacgatcccgtcttcggatacggcgaggcattgatacgtttcccgatttccttctccgtcacggacattgcctgtgtacatcaggcagagccgcccgtctttttcgatggcgcttccggaataacagccgtttttgtcataccactcacccggcgcaagcgcgatttcttcctctttccactcaacgaaatctttcgtcgtcacatgcgcccaaaatttcgcgccgtgccccgtatgaaatggctgccattgaaaaaacaagtgatatacgccgttccattggatgacgccgttcggatcatttaaaagcccgaccggcggcataacatgatagttctggcggtatggatctgacgcggctgtttcttgccgcttctttttcgcttcctcagcctgcaggcgcagctcttgatccggtgtcctcatttgacggcctccttttctttagctcccataatgtaagcggcaataaacgccgagacagaggcgatgcccattccgatcagatagtttataagatttcctaaaccgagcggagccgtgatggcaatcatcggaattccggtcagaccgtaagcattggcggcgacgccggtcaccacgacataggcccctcccagcgctccgccgatcattcccgcgataaacggcttccggtaccttaggttcacaccgaaaataactggttcggttacgccgagaaaagcggaaaatgcggcaggcagagcgatttctttcattttcgcttttttcgtcaggaaaaatacagccagtcccgccgcgccctgagcgacattcgccatcgaccagataggaaggatatagtttctgcccaaatcagcgatgaggccggcctcaatcgcatgaaagctgtgatgcacaccggtgagcacaataagcggataaagaccgccgaaaagaagtccggcaacaatgcccgcgtgatcatacacatatgtcagcgagacggtaatgcccgatccgatcgccctgccaagcggaccgattgcgataaaggtgataaatcctgtgacaatcaccgtgacaaacggggtgaccaataagtcgaatgcgtgaggcaccatttttctcgtgcccttttccactttgctcataatgtaaacggctaacagtacggggatgaccgtcccttgatagccgagcagcgcaatgtcgaagccgaagagttgcataaaatcaggcgatgcatccgcaagcccccacggattcaaaagcgccggatggatcataatccccccgagcacggcaccgagataggcattgccgccaaattccttcgccgcactgaacccgatgaatacgggcaggaagataaacgccgcgcttgaaaacatgtctaaaagcttaaacagcgatgattgttcagacacccagtggaaagccttcatcataccgagcagccccattaaaagtccgcttgccacgatagccggaatgatgggaacgaatatgttagacagtgttttcgcaaatcttgcggccggattcagcttttttttcgccgcgtcctgatgtgtctcacgatcctcccgccccaaatcggcttcttttgaaaaagcgtcatacactttattcacaaggccggtaccgaatataatctgatattgccccgagctgctgaaagccccttttactccttctgtctcttcaatatcggcctggctgatcttctgttcatcttgaatgacgagcctgagccgtgtggcgcaatgtgtcgcgctgatgatatttgatttccctccgatatgtttgataagctgttttgccgtttcttgataattcatgatgtatccccctttctaaaatcaaaaaagacctaaaattcgccaacgaaaaaggtcagcatgatccctttttcatgtacgcaaattttaggtcttgcctgcattaccagtcacaatcccgccgattcagttttttaatgcgctttcattttatttcatgatagcgctttcgtcaatatgttttcaaaaaaaaagtctgtttctcgaaacagacgcgttattccgggtttttttgcagacgctggacatgcagcgtaatatagccggcctcggattccggcagttccaaatcatattcattttttaaaaacgccgccagttcaagcgcacaccgataagcaaacggatactttttttggatgaaataaagcatctcctcgtccatggaatggagtgcttcatttgagtccaaccggctgaccgcataccgtaagtgcgtgacgaggcgctgataggaaatactgtcttcatccaccttctgttcgaaaaaggattcgatcttttcgatcatttctttgatcatggttgtatgcttcatcgccgaatacatgcttttggcatccgccttggcagtgtggatatgaagcgcgatataccccgcctcatcatcaggcaatgatataccgagggtttgtttcacgtgttcaaccgcccagcggccgatttcatattcttttttataaagcgccttaatttcatgaagcaatcggttgtgcacctgaaggccgttttgaatcctttcgatcgcaaaggataaatggtccgccagcgcaatgtggatgtgatcgttcaaaggcgccgcaagctctccctccgcatggctgatgatatcttcagccgcctctatatgctcttcgggaagcgtttctaacacttgtttgaacttttcattttcgtcgtgcacgacaaatattttttcaattttatgtttttgaatcacatcattttttctcttttgaaaagcgattccgggacccattacgatcttttcccgtccgtcttcttttattaacgccgcattgttatttaatactttgtctattctcaagaggttcgctcccgttcatatgtttagtgggattgtaccctctttttcatatgatgtaaaggtgccggacccgcgcgctcccgtttcggcaattctttgcggacaggcatccatcggtttttatccagcctgccgcgggccgatttcgtttcatcggtcaaatccgccgatcggactcggctcacaaacgaaaaagcaccagccgtccgcttcgctttcttatgataagccgcttggtttccgtacacggcggctaatggatatcttccgttacccggcgccatccagttcatcagaaagaccatccacacccgtaaagatactagcaaacgtttcattgcaaatcatccctccgcttctttttgacagacagcttgttcgcaggcctgtttttctctccgctttaacggaaaaggcggccgatccttctccgctaaaaactagcgggtctagcaaccctatgactctatgatagacgcggccgggcgaattgtttgtcacaatatgagtgaaaaaacaaactagttttcagaagttttgttgaaagctgatggaaatgacctgaaaaatggaaaagccgataaaaaaagttatacacaccttatcccttggttaagcacagcttaaacacagggtatatccacatatccacaaactcgatctatattttgtatgggaacactcgttcccaacaatatatatacacaattttattcagttatgcacaggattctgtgtataactccctccttattcacagaccaatttccataaatgagtcatatgtcacaaggattattttgaattttcaagaaatatatactagatttctaatttagataaagaaaaagggggaaacacgattgaaaaaaggaatcatccgttatctgcttccggcttttgtcttatcctttaccttatccacaagttcacaggctgcgccggcttcaaaaccgcaaactcctgatcttgagaaggctgaggtatttggtgacattgatatgaccaccggcaaacaaacgacagtcatcgtcgagctgaaggaaaagtcactggcggaagcaaaggaactcggcaaagcacagacaaaaagcaagctgaaaagcgaacgctcaaaagtgaaaaagaaagcgctcaaaaccattaaacacggaaaaatcaacagggaatatgagcaagtgttttccggcttctccatgaaactcccggcaaatgaaattccgaaactgctgagtgatcaggatgtcaaagcggtttatccgaacgtcacctatcataccgatcaactgaaagataaagacatcaccctatctaaggatgccgtgtctccgcagatggatgacagcgcgccttatataggggcaaatgacgcgtggaagctcggctatacggggaaaggcgtcaaggttgccattattgacaccggtgtcgaatataaacaccctgacttaaagaaaaatttcggacaatataaaggatacgattttgtggataacgattacgatcctgaagaaacgccgtccggtgatccgagaggcgcgtcgactgaccacggaacccatgtcgcgggcacggtagcggcaaacggaacgattaaaggcgtagcgccggatgctacactccttgcctaccgtgtgctcggtccgggcggaagcggaacaacggagaacgtcatcgccggtattgaacgcgccgtacaggacggagcggatgtcatgaacctttctctcggcaattctgtgaataacccagactgggcgacaagcacggcgcttgactgggcgatgtcagaaggcgtcacggccgttacatcaaacggaaacagcgggccgaacaattggaccgtcggctctccgggagcgtccagagaagctatctccgtcggagcgacacagctgccgctgaacgagtacgccgtctccttcggttcctattcctcagcgaaagtaatggggtacaacaaagaagatgacataaaagcactgaataaaaaagaaacagagctcatagaggcgggtatcggcgagcaaaaggattttgaaggcaaagatctgaaaggaaaagtcgcggtcgtcaaacggggcagcatcgcctttgtggataaagcagacaacgccaaaaaagcgggcgcgatcggtatggttgtgtataacaatgccccgggagaaattgaagccaacgtaccgggcatgtccgtgccgacggttaagctttcatcagaagacggcgaaaaactcgtcagccaattaaaagcgggcggcacaaaagcgacattccatttatccgtggctaaatcgctcactgaacaaatggcagacttttcgtcacgcggtccggttatggacacgtggatgattaaacctgacgtctccgctcccggcgtaaacatcgtcagcaccattccgacccatgatccggccgacccgtacggctacggatcgaagcagggaacgagcatggcttccccgcatgtagccggcgcagctgccgtcatcaagcaggccaaaccgaaatggagcccggaacaaataaaagccgctcttatgaacacggcggaaaccttaacggacgcggacggtgacgtatacccgcataatgcgcaaggcgccggaagcatcagaatcatgaaggcgatcaaagcagactcccttgtcgccccgggaagttattcttacggaacgtttatgaaagacaaaggcaatgaaacgaaaaaagaaacctttacgattgaaaaccaatcgtccatcagaaaatcatatcagctcgagtactctttcaacggcacgggcattaccgtttcgggcacagaccgggtcgtgatccccgctcatcaaaccggaaaggtcaatgcgaaagtaaaggtcaatgccaaaaaagtaaaggcaggcacctatgagggaaccgtcacagtgcgtgaaggcggaaaaacagtcgcaaaagtgccgacgctgctgattgtaaaagagccggactatccgcgcgtaacgtcaatcgacgtacaggacggcacaacgcagggaacctaccaaattgaaacctatcttccggctggagccgaagagcttgccttccttgtatatgacagtaatcttgactttgtcggccaagccggcatctacaaaaagcaggataaaggctatcaatatttcgactggaacggcaaagtcaatggtgacaccgcactgccggcaggagaatattatatgctggcctatgccgcgaacaaagggaaatcaagccaggtgctgactgaaaaaccttttatcattgaataaccgaacaaccctgctggagcatcagcagggtttctttctgattaatcggcaaaagcttctcgaagcagacggtatgactgaagtttatcttcaaaatgatgagtaatggttacagccatcacttcttctgttccgtatgctttactgagagccagaatctgttctttcacttgctgcttcgttccgatgatcatccgattccgattatcggcaattcgtctttgttcatacggtgtatacgtattgccgcggacggtttcgtaagacggtacgccgtgaagcggaatcccctgttcacccgcaagcagcgtataatccatgacagccgcgagttcctccgctttctcctccgtatccgcgcacagcacaaacaccgccacggccgtttttggttctttacctaatgcagaaggtttaaatctgcgcttatattgtgctgtcgtgctttctccgccttctccattaataaaatgggcaaacatatagcctgctcccatttctgcgctcagaaacgcgctttctcccgaagaaccgagaagccagacttccggcgccgtcttaataaggggtgatgcggtcagattcggaaaacggtgattgtcatcagctgcatcatgcaaatacatcgccagctcacgaagctgctgcggatattgatcagcattacgcttcccgccgtcattcagcgcccatgatgcgatcggcattccgcccggcgctctccctaatccgagatcgattctgcccggcgtcaacccttcgagcacgcggaaattctccgccactttatatgcgctgtaatgcggaagcatcacaccgcctgatcctacccgaatgtcattcgttttcgccgcaatatggctgatcagcacttcagggcttgagcccgccaaccgctctgaaaaatgatgctctgacacccaaaacctcttatatccgagcttttccgcctcctgcgccaatcttactgtattccgcagtgcactttccgcagaacacccttctgatacaggagattgatccaatatacttaatgaaatcatcactgtcacctcatcaacatcgtaccactgctaagccgttttttctttctgtatgcttatcagcatccctgatgataaacatttatataccttgttccattttgtcgaaatatgttacacgtgaaacataaaaaaacctctcccggtcaggagaggttttttcttaattcttttgaaaacctttatcttttacatattgatttaaataggttctcggtttttgtttcatgaactgcaggatttgatcagaccacgtttcaacccgcttgccgtttgtccgtttatcataataatcggaaatggtttcatcatattccttcatataactgcggaagttttcttcattcgtatcgtacgtgttttcatgatatacggcttgtttcggcaggcgcggcttttgaccggacggatgagcgggatgaccgactaccaagccgaacagcggcagcacatggtcaggtgtaccaagcacttctgtcacctgatcaagttcatttcgaatgcctccgatataacaaatgccgagtcccattgattccgcggcaacacttacgttttgtgcggcaagtgcggcatcaatgatgctgaccataaacatttccgtattctcaagaagctcggtaatgttttctcctttttcctcagcaagttttttatggcggtacaaatcagcgcaaaacacaaacaagtgcccgttattttcgacgtaaggctggtttccggccagtgccgccagcttccgctttttctccttatcggttacgccgatgatggagtaagcctgcacgtaactggacgttgacgccgcctgggcgcttttcactaatgtatctatctcttctgctgtcagaagctcgtcagtaaatgatcggatcgaccgatgattaagtatggtttcgatggtattgttcatatataaagcctccttctctatatatcatatccgaaagagtatcatgccaaaagcgaaatgctctaaacaaaaaaagacagcccgaaaaacgagccgtctcacattaagaattgaacaagtagcttttatatttcgtcagctgcacacttgcgttatatacgatcccgaagctgattaatgtagaaagcaccgagctccccccatagctgacaaacagcagcggaataccggtaaccggcataatgccgatattcatcccgatgttctggaaggtgtgaatcacgataagtgcagtaaatcctacgcaaaaaaacgcaccaaatcggttaaacgcatgcaagcggtcaatcagcaccacaagcctgtaaattaaaaagaaaaacatgacaaccgcaatggcgcagcctaaaaatccaaaactttcacccaaaatcgcaaagataaagtcggtctgtccctcaggtacgtacactttcagattatgaacgccgtttccggtaatgccgcccgatccgatcgccataacggcctgatccacctgccagcttttatcgctctcggcctgagtcgttgccgcactggagtcagacatccacgatgtaatccggttaatttgataatccgcaataccgatcgaattcgccacatggggaaattcaattacaagcactaagaataggccaagcacaagcgcggccgaaccgccgatgatggtgatcagcttccagtttacacctgacataaacaccatcaccataacgataaacagacagatcgcacccgttccggcatcctgcaaaacgatcatcccaattggaataaccgtccatgccgcaattttcaaaagcagattgacatcttcccgaagtgatctttgatctttcgggcccgccttcgatataatggacgcgaccatcatcataattcctattttcgtaaactcagagggctggagggtaaagttgccgatttgaaaccagctcttcgctccgtttttgatcggcgcgatggattccggcgccacacgcaaaaggagcagcgacagcacgccggcaatcaatacatacagactcagtttctcaagctgctctaaatcaaagtacagcaataatccgatgaatcccgcacctataacatagaagacaatctgtttcatccaggcactgcctccatactgcccgaactgtccggccgcataaatcgccgcaacactaattattaaaaacacaccaaatataaaaatcaaatccccctgataatagggattttgctgtttcttatatcgactcattctatcccgccttacattttcatcggaagtcactattgtttattatacatgaacaccgttcaagaaaacatgatgaggttgcttcctttttattttttacggtttggggactacacgacatatgacgtgtcagaaaaggaaatgtttcggtcatgatgaaacttttccgataaaaaaccccttctcgtcagaaaaggggtttcagtctatgtttaacgtcataaacaagctgttcgggtcctctttataatgtgcaaacggatcacaatattgaaaccctgctttttcatacaggcgtctggcggggagaaaagcctccatagaaccggtttctaagctgatccgctgatagccccgccgccttgcttcttcaagcatatggcggaggatccggttggctgcgccttttctgacatgatgcggagccgttttcattgatttgatctcaccgtgccggctgtttagctccattaaggcgccgcagccgagcaggacgccgttttccctcgcactccaaaacgtaacgtcaggctgacgcagccggtccgcattgagcgcgtgtatactttccgggggagaatgcatggtcatgctcttcagatgctcctgcaaaagcgcaatgacgtccggcgctgtgacatcgtcttttgttatgtccacttcaaaaccaccctcgctgtgcatgttttctttgaacatagcaaaggttcacagcctgcgccattcccttgtccggaaatgtgacagggtatttgacctttccggtttcttgtacctatccaaaaatgaggcaatagttgcaatacatttctcgataaagcggtatcaaaaattggaaaacatggtataataattgtaacaaaatgttcaaaaaacgaccacaaaacagacacattttattctctgtatttcattttggaaacgctcccataaaatgaaaggagacatgtaagatggacatgttttttgcttatttactggtcgcaagcgcaacacccctctttatctggctggataacaaaaaagtcgctctttcggccataccgccaattattctcatgtgggttttcttctacttttacgcaaccagcagcctgtcccctctcggccacacactcatgatcatcctgtttgccgtcaacgtcatcgttgcccatatcgccgcctttatcatttacggccttccgcgcctgcgccggagaagaagccaataaaggcacaaaaaaccctcttcgcctgaacgaagagggtttctttttattcctgatgttcggaatgttgcttcgcaccgccaggagggtttccatccatatggtcaccgtgatggtagtgcgccgcaaagatccagatggaaccaaggatgataacaatcgctccgaaaaatccgaagagcgtgtttccgacttgaatcccgccgttttcgctttctgtcatgtgcatgaacatgagaagctgaagaccggcttggataaatgcgaatccgaaaatgatccacagttttgctgatgagcttaaatccgtatataccgcaacccaaagggccagcagggtcagaataatagacaacgcaaaacctacgatatgcttccacggaaagtggctgtgttcagcagatttgtttgccatattatagtccccccaatccgatgagatagacgcctgtaaagatgaagatccaaacaacgtctaagaagtgccagtataaacttgagataaagatttttgaagacgtctgcggcgttaatccgcgtttcttcaattgcagtaagatgccggcaatccagaagataccgatcgttacgtgcgttccgtgcgttcccagaaggacgaagaatccagaccagaaagcacttgtaccgagagatgctccttcatgtacatagtggatgaactcgttaagctcacatccgacgaagcccgcaccgagaagaagcgtaatgatcgtccaaatgacgacgccttttaaacttccgcgacgcatttcatgaacagcgatcccgcaggtgaaactgctgatcagaagcaggaatgtcatgatcatgacaagcttcacttcaaataattcagccggtaagactcctcctgctgttcttctttgaagaacgaagaaggttgcaaatagtgttgagaacaacacaatctctgcccctaaaaagatccaaaacccgagaatattgagtctgccggtttcagattgatattccataggcgcgttagaattgccgtgttctgcatgttccataaatcacgcctcctttattcggaaatctttctttccgtctcttttatttcttcaacaggtatatagtagccattgtcatattcaaatgaacgaagcaccatgcaaagcagaatgccgatcaagccgacaatgcccatccagaaccattcaaatacaagtccgaagccagcaataccgaacgccactgacataataagcggtcttccggagttgtgcggcatatggattttcttgaacttgctttccggatgaatatccgttttgtcttctttcaattgcaggtacgcatcttgagatttcacttctggaagcaccgcaaagttgtaatgcggcggaatcgcagatgaagtcgcccactcaagcgtacgtcccacgccccatgaatctccgctgatctcgcgagtagagtagcggaagctgtagtagatgttgtagcaaaggattaagaatccgacacccatcatgaaggctccgacagttgaaataaagttcaatgcagtccatccgtcattcggtccgtaagtgtaaatacggcgaggcataccttgcagccccaagaagtattgagggaagaaacatacattaaatccgatcataaagatccagaagaaccattttccgattctttcgttcagcttgtggccgaacattttcggataccagaaaataaatcctgcgaaacatgcaaataccgtacccgcgatcagcacatagtggaagtgagatacgaggaagtacgtattatggtattgataatccgctgcagccatcgcaagcataacccctgttaccccgccgacaacgaagttcgggatgaacgcaagcgcccacagcatcggtgttgtaaaactgatccggcctttatacatcgtaaagagccagttaaagattttaaccccggtcggaaccgaaatcgccatcgttgtaatcgagaagaaagagttaacggacgcactgttccccattgtgaagaagtggtgagtccatacaaggaaactcaggacggaaatggcgataattgagccgaccatcgctttgtaaccgaataactgctttcttgcaaacgctgaaataatttcagagaaaataccgaatgccggtaagataacgatatatacttcagggtgtccccaaatccagaacaagttagcccaaagcatcggcataccgccggcttccagcgtgaaaaagtgagcgccgaacaaacggtcaaatgataacagcgccaatgccactgtcaaaacagggaaggcgaatacgataataaccattgtaatcagcgtcgtccatgtgaacatcggcatacgcatcagcgtcatgccttttgtacgcattttcaggatcgtcaccataaagttgatacccgtcatcagcgtaccgataccggcaatctgaagaccgagcaggtagaagttctcaccaggcccgggactcatgtcgttgcttgccagcggcatgtaactcgtccatcctgcgttcggagaacctccgataacgaaagaaatattgaaaagcatcgcacctacgaagaacgtccagaaactcaggttgttcaagtaagggaatgctacgtcgcgcgcaccgatctgcaaaggtacgacaacgttgatcagaccgattaaaaacggcatcgccatgaagataatcatgatcgtaccgtgagtcgtaaagatctcattatagtggtttgagtctaaaaaactgttattaggaagcgctaactgggcgcgcatcatcaagccgtcgaccccgccgcggaacagcatgataacagcagagataatgtacatgattccaagtttcttatggtctacagacgtcagccattcagaccagagccatttccactttttgaagtatgtgagtacaacgatgatagcgatagtggaaagcgcaatggaaacttgtgcgcccagaattaatgggtcacctgttacaaaaaattcatcccatctcaatttcattcgggcttcctcctttcttgttcaatttcaatcttgtttatcgtcggatactttaaattcgtttttctttacatcttcccacgggtctgttttagagtgcggtgatacggctttgtagccaaggcgtttgcgcgcctccatcgcatattcggcatcttggccgtggtcaacgtattttaagtgtgtagaagagaacgttaattttccgacattctccggaagcatcagttcgtcatacttctctttcgtcagctttggagaatcgctttgggcttttttcacccagctgttaaagtctttttgcgtaacagcttttacgttgaatttctggtcggcaaagtgttcgccggtgaagttcgcgttgcggccttcatatgttcccactttgtcagcctgtaagtattgatccatcagcattcccgccatcgcgtatttttgtcccccaagctgaggaatccatagcgatgccattgaatctgctgaagaaattttaaataaaaccggacggtctacaggaatgttcaggtagttaaccgtctcaatatcctgctcagggtagctgaatacccatttccagtctaccgaagtagcataaacaacaagaggctctttatcctttgtcgcttcaggcgctttttctaacgaatatatcgtctgtacggtaggcacagaaagtgcaataacaattaaaattgggatcactgtccagactacttctaagaacgtgttgccgtgcatctcgggcttgtaatttccgctgtctttgcctttgcggtcgcggtatttcactaaaatgattgtaaatagtacgaatacgacgccgacaatgaacagcataaatccgattgacaagagaatcagatctttctgctggtctgctacaggtcctttcggatctaaaacggaaatgtcgctgcatccgcccagtacgaaaacaacagccaacatcgctaataaaagtaacggtttaaatgctctgaacaagaagatcaccatccttcctattgatgtagtgaatctgaaatgtactttctcaaaatcttttctctatctaccttgttatgctatcaaaatctgcccttattagctttatttttttctaaagttcatctttttttcgacctaatgtcacaaaatcgtcaaaaaatgcatgagctttttccacttgcgtaaatcaaacataaaaagttttagatcatttagcatatatagagaaaaaagatagcgagaacgaataataccaaataaaggtttaccataataaaaatcgctggtcaacaaaaagtttcattttgttaaacattctacaaaagaaatattttttcctttgctcacaccttttcacacggtttccattttaacgcaacgcattgtgaaaaaaaagaccggaacgcgccttgatatgttcattataaaaaacgcattcatatgtttaatatggacaaaacgaaggaaacatataggcataaataataaaaaataggaagtgatatttatgggttttatcgtatctctgattgtcgctattattatcggctggatcggaagtttatttgtaaaaggcagtatgcccgggggaatcatcgggtcaatgatcgccggtctgatcggcgcatggatcgggcacggactgctcggcacatgggggcctcaccttgccggctttgccatcattccggcaatcatcggagctgcgatcgtggtattcttattcagcctgatcgccagaagcagaggataaaaaaaagcctcgtcccttatgggatggggcttttttccggtagagcgcccaaatggcggataaaccgccggaaagccgctctgccttcttctgtctgtttaaagacgccggcatgctccagtatccgcgcaaaggcatggccgatttcctctttcagaatctgttccgcgttttctttcgttaccttccgcttatgcagcacactgagcgcccaatctttatgctttgccgcagaagggtctgccgttaagaccgcctccgggtccggtgagcacagcgcttcagccgtgtatttcatttcttgttcaaggcggcccggcagaatcgcaagccccattacctcaatcagtccgatattttcttttttcaggtgatgaacttcctgatggggatgaaaaattcccagcggatgctcatcagaggtgcggttatttctgaggacgagatctaattcgaataaaccgtttctccgccgggcaatcggcgtaattgtattgtgcggtgtttctcctgaacaggcgaggagatcagccgcctcatcggaataaccgcgccatgcccgcaggatggcatccgccgcgccggaaagctcagacgcgcactcactctgcaggcggatgaccgacatcggccacttcacaattcccagcaccgttttcggatagtcaggcagcctgtaccagctttctgtctccgccagcgccatcgggaattcataatggcccccctgaaaatggtcgtggcttaaaatactgccgccgacgatcggcagatcagcattggaaccgagaaaataatgaggatactggctgacgaacgacagcagccggtcaaacgtttttttgctgatcttcatcggttcgtgccggtctttcaaaacgatgcaatgctcccggtaatacacatacggagaaaattgcagaaaccactgctcatcgccgagaatgaccggaatgacacgaaggttttgacgcgccgggtgatccggtctcccctcgtacccgacattttctttacaaagaacacatcccggataatcggattgaggctgctctttggcagcggcaattgctttcggatctttttccggttttgaaaggttgatcgtgatgtccagctttccgtaagccgtctcagccgtccatccgacattccgctgtattctgtccgaacggatataatacacatcctctgaaaatcggtaaaacgcctttgtcgcctgctccggcccgtgcaccgcctttgtttcttcaaaacgacgcacaatctcggacggctgcggggcaaagcagcccatgatcttcgcgctcagcaggtcgcgataggtgtctgtatcggctgcaatccggcccgtttctgccgcccattcataaatcggggccaatatgtccggcaatgatgccgccgattcattttctttctgttctgaagcctccggatgggtaatatgcaaagtttcatataaacggtttcttgtatattcaatatcaagaaatgaaatcagctctttttgcaatccgtactggattaaacgttccacgtgccgctcaattgccatcgtcatccccctttagttctctcgctccggcgccgatatccgccgtgtaaaagtcagcttttctctctgtcttctcctcatagcggcccccgttagctctccgatgagattcactctgccgggcgcaaagaaaaagcgcaggtctcggattccccgaatacatcagcaaacgctttctttattttgcgcttcaaacgcatccccttccaccattacactttccccccgggacgcggaaagaaacggttatgacacgccctcttctttcgcttttctgaagacaatccacttgctggccgcatagttgacgactacaataatgacgttatcggcgattttcgccaatgtttcgttcatatgaaattgactgaccagaagaatcatcatggcgagatcgatggcgagagacagtacccgcacgctgaaaaaggccgttaattctttcatcagactccgcatccccgcggtcttttgctgaaagacataccgtttattcgtaacataagcaaatagaacggacagaatccaagcggcgacagtcgccgccttgtaatccatctcaaatgccgacgtcagaatgtaaaaactgacgatattcacgatggtcgtgaatatccccataatgatatacatcataatttctctgtagcgcatggcagttcctcgctttctgaaagacttttctaaaccttttgtcaaatcaagaagaacgttaccctgattttctggtgctgacaaaaacatagagcgcgtcaaacatgctgcggaaagtaaccggccttcccagcacattggattgcttaatcaccccgtcgatgagcgcgcacatcatgttagcggtatgctcggtatctatatggtcttctattaaatttctcgatttgagccaatttatgtacatggtgctttcttctatccataacttatacaggcggatataagcttcatattcactgacgactttgtaagtaggcatatgaacggcaaaagacacaacattccaggcaggcttgctgtttacaaaccgcatcaacaggctggccgcgctggccgcggcttcacaaagcgtcaacggccgctctgtttgcttttctaattcgtcgagatagccagtgatgatcctttttttaatctgacgcctctctaacaaatgcttcagaaaatcttccttgctttcaaaatgaacgtaaaacgcccctttgctgaaacccgccgctttactgatgtcatcgattgagactgaatcgtaagctctttcaatcaggagatgaaggcctgcgtcaataaaactttcaaatgtttcttctctcttaatttgaaatttgttttttttcattttttaccccagctgtttgatcattcactttatcttacaccgaatcattcttttgcggtattttttatgcaaaaagaatatgctaatcgacgttttgagggtaaatgttaataggtcatatggtttatttttatttgcatactatccagtcagtatttatttgtttattattatatgtaagaattcttgaaggattttggttatttcagtcattttcttagggaataggtaggtgaattcatcttcaatttgggattaccggccaactatgtgtgatatttgttatacattggctgctgtagctgggcaaatcaatttttcaattggaggttcttatgaaaactcatgtaatgaaagatatagatcaagattggcaattgttaattcaagaggctagaatcatgggtttgcacattgacgatgtgaggcgcttcttaaatactgaaaaagcggtgaagaaaaaaacaccaatgaaaaacaccatccgccagcggtaagattacaggcggatccttttactatatgacctgccacagtccgcccgcacccgagttttcaaaggaacacccgcaataagaggggaatcagagaacaaaccgtataccggacaaccattcccgtccgcattccgcaattgaacagccaaacatggtgatatgagatcccccgctgcatatcttgtgtattatgcccatttatgaggtgatacacagatggatacgaatccctattatgatgaaaaacaacagaactactacgaaggcctgaatccttatttattgaacaaaatagacgaaaactggcggacagtgcttgatgtcggctgcggcacgggcaatttaggagcggcgatcgaagaccgcggaataacggtttacggcattgaagcgtatcccgaagccgcaaaaaaggcggaaagcaaattgagccacgtgctttgcggcgacattgaatccgccattcttccgtacgaatcagagcaattcgactgcatgctgttcggagacgttcttgagcatcttgtcgacccgtggacagtgctgaaaaagcttcgtccttatgtaaaaaaagacggcactgtgcttgcatgcataccgaatgtcggccacatctcagtcgtgttggagcttttagccggcaaatggacttacagtgacgccggattaatggatcagacccacctgcgtttttttacccgggaagagactctttcattatttaaagccgccagctatgaggtcaaacgcattgaggcgatccgcgttgatcacccttcttaccacaaagccatcgcatcattgcacgaagtatgcgtacagcttggcataaggcatgactttatgacagaagcatcggcctatcaatatgtgattgaggccgagaggagcatgtaatggattcacattcatttctgtttgtcgtctgtgtgaatgatgagtcgctgtactcccggtgcaagagccatatcatgcagcttaccgtccccccttcatactccgttgatatcatgccgatatacgattcagcaagcatggcctcgtcctacaacaaagcgctgaaacacccctccaaatataaaatttatctgcatcaggatacttttatcattcatcagcatttccttcatgacatgcttcatatctttcaatctcatcaggagctcggccttctcggtgtcgccggctgcaaaaccctgccgccgaacggcatttggtgggaaagcggacagcggatgggaaaagtgattgaataccgggggaatgcttatcacccgctggattttgagcacggtgatgaagacggcctgtttacgcccgctgacgccattgacggcttgttaatggcggctcaatatgacgtggagtggcgggaggatttgtttcgcggctttcatttttacgacacatcacagtcgctcgaatttcaaaaacacggctatcaagtcggcgtcgcctgccagaaagacccttggtgccttcatttttgcggcgactcctttgacgccgcggcatatgaagcggacagacaaacatttgtcaaacactatatggcaaagccctctcgctgatcgagagggcttttttcgggttaacgtttattcagttcccgctcaatgatttgttcaaaggtttcctttcccgccgcgccagggattctctcatcgccgatgataaacgtcggcactgccgtaatgccggcttcctcataagcatggcggagcgcttcccgctgtacgtccttgtacgctcttgtctcaagcgcctctttgaaggcagcgccgtcaagtccggcttcttccgcaagctttgtcagcacgccaacgtcaccgatattttgttcttcctgaaagaacgcctgaaaaacgcgtgtatggtattcgcttcctttcccgtgttcctttgcgaaatgaaagccttcaaatgccaaatccgtgtatggatgcggtgacacgcgggggaacgtgatttcaacgcctaacgactgcgccatcggctcaatggagtttttccacatctgccgcttggcgggatcattcaccggatcaagtttcggcgaggggctcggacgcaattcaaacggcatccattccacctgtacgtccttgtccttgattgcttcttcaaacgccgctttgccgacatagcaaaacggacatacataatcagaatatactttaatctgcagtgtcattgtaagtctcctttccttatcattttaagttgtaacttttatagttacaagtgttttttttaaaaaaaacaccctccatatggaaggtgtcacgattccagcagcctttgggcgatatattctccttttttacagccgccgggacaggcgaataaggaagagccgatcgtttgtgtgtattcattcagcgcatcctttgccgccaaagccttcagcatcgggacaaattggcggtccgggtctttttgaaagcagataaacaacaggcctgcgtcaacatagcccgtcttcggatcaattccgtccgtataggaaaatgcccggcgcagaatctgtctgccggttgattttgccacgctgacatgcgagtcggcgggaatttgattcagcttcacgggatcggtttcctttttttgtccgaaaggcgcgcccgagcttttcacccgcccgaacgtgtcctcttgttccttcaaggatgaacggtcccatatatctaaaaacatcttaattttcctaaacgccatgtacgtgccgcccgtcatccagtccggctctcctgattgaacccaaacgatcgaattcatcaggttttcatccttcgtgctttggttgccggtgccgtctttgaatccgaagaggttgcgcggtgtttctccgttttttccgccgcttaagaaacctttattgagaaagcggacttcacacacacccgatgcctgtttcatcaggttgcgcaccgcgtgaaacgccgtttgttcattatccgcgcagacctgtatgacgatatcaccgccgccttgtttcttatcgagcttgtcgttaggcatcggcggaatatcggcgaggtgcttcggttttttatctttcagtccgaagcggtccttcccgtctttctcgaaaaacccggggccgaagccgaaggtaacggtcaaattcgccggtgccagatcctgcgactccccggtatcctgcggaggcatatatttatttttctgttcgcctgacgggacggcgcctgaagtcagcagctgcgtcaagcttgtccattgtttgaaaagggagatgacatcggctttgtcgcttgacatgacatcaagcgccgcaaaatacacatacgtctgatgcgccgttgtgattcctgcttggtgctttccgtaaaaaggaacgatttgatcacgatcacgtttttcatcattcttctttgaagcggtggccgccggtttgaagagcggcgcgagtcctccgaggccgctcgctccgacagcgacggctgcgcccgcgacggcgccccacttcaggacatcccgtctgtggatctgtttttccttgttatgttcatcgctcatgctgtgtcttaactccttttaaagcacatcggcaatcttcgacatggtttcagaaagggccgtcagcttcgtgcttatctctctgatttgatctgtacttaatgtatcacaagacgtatacattgatcgcacgttttgtatttcgacatcaaaacttcaaattcgctgaattccgcattaagtttttccgtgacctcgaaatggtctctcacttcgcgctattcactgttttatagagggcttttgagcctgcgctgattggttcaggcgtcactttgagagaagcgatagagccgtcaaacgcttcggtcgatattgcaagcttgattgctctgttcttgacatacggcttctattctcccagtccgtcacgcctttttgcgcacacagaaaaagggccgccctatcgggacagccctgctttggagcgccgaatttcctctgaaaacttccgcgccgccgcttttggatcttcggcttggctgatggcactgatcatgctgacgccgtctgcacccgcttcaatgacgggcgccgcgttgtcagccgtaatgccgccgattcctacaatcggaatggtgatgccctgacgccgtacctcttcaatcaatgtaactccctgcacggcttcagcatctttttttgtttcggtcggatagaccgggcccattccgacgtaatcggctccggcttcttccgcccgcttcacctcggagacgttatgtgctgacacaccgagaatcatatcgccgattgccgctctcgtttcttcggcgtctgcgtcatcctgtccgatatgcactccgtccgcctcaaggcgcaaggccaattcggcatcatcattaatgatgaaaggaatcccggcctgcctgcagacatcctgcacccgcttcgcgaacaggacacgttcatcccctgttaaagaaccgctccccttttcccgaaattgaaaaagcgtagcgccgccctcaattgcttttttcaccacggaaaccgggtctgcgcttgtattgtttgatcccataataaaataaaccgataacatattcttcatcatttcccgagaaatacgcgtcatttttctatcaccctttcaattgcggcaagctcagccgcttcttgttctgagatgcttgccagcttgtttaaaagctcaatctggaagctgcccggccccttatgggaggtgtccaaagcggcaagctgagcggcgcttccgtatacagaaacggctgaaacggccgcttgcagaacgtcctgccccgctgcgcagaaggctccgattacagacgtcagcaggcatcccgcccccgtcaccttcgtcagcagtttatcaccgttttgtacggcgtatgtgtcggtgccgtcggagatgacgtcggtttttccggtaatcgcaatgaccgtcttcagcccgcttgcagccgtcttagcgagctgaaccacatctcctccggcttcccccgcatccacgccttttatcttccaatcaggggcgccggcaatattggcaatttccgcggcatttccgcgaataacggacaagcggacctcctgtatgatcttgcgggctgatgccgtccgaaacggcgtggcgccggcgcctaccggatcaaaaatgaccggaacaccgttttcattggccgattttccggctgcgatcatagcttcaaccgatgccgagctgagggtgcctatgttcaggacgagcgctccggcgattttcgccatgtcggcggcctcctcaattgcataagccataacgggcgatgcgccgagcgcgagcagtccgttagcggtgaagttcgtgacgacattattggtgatactgtgaacgagcgggttttgatcccgcactttactcaagtgttgagctgcggtttgtgcgtccatgcttaatcatccttttttctctttttcggattccataaatacgatttcgtatgctccagccaggctctggcggcaaaggacatatagcggtccttccgccaaatgatggctaaatgccacggaatgaccggatgaacgagcggaatggttctgactttgtcaggatcaagaccgcgacagattctttccggcagcaggccgataccgagattggcggataccatttcgctgataaagtcccactgtgatgtttcataaatgacatgcggcctgaatccggctttcacgcattccgtcataattcgattatgaaggacaaaatcctccctgaaaaatatgaacggctcttctttcaattcatgaagactgcattctttctcgtcagcgagccgatgtgacggatggacgacaagcataagggtttccttgacgattgtgaaggtatgaaaaatctcttcattcgcgggaagcacgacgaccccgatatcaagcgagccgtcctccaccccttgctgcactttaatagagccgtcctcaacaagctgaaacgtcacatcggggtatgtgacgcggaagtcaccgagcactctcgggaaaaagccggacccgatcatcggcggaagaccgatgcggacgtgccctttcttcacttccataatatcgttcagctctgacgtcaggttttggaatgactttgtgatttcctgcgcctgcacatacatgctctgtccggcgtcagtcagttcaacttgccggccattgcggtaaaacagtttaatgccgagctccgtctccaggtttttaatcatttttgagattgtcggctgtgaaacatacagagactgtgaagccttcgtaaagcttttcaaacgggccacttccaagaaatacgttaagtgccggatatccattacatttcatcctttctatagacaaaaggaatacacattattctttatatgtattttacctatagcaaaaccttctgtacaatataaatataagggaggcatcattatgaaaaaattgctgcttaccgttattcaaatcgctctgctgtttatatttgcgcgtctgatcaattggatcacggcggctcttcatataaatattcccggcagtataatcgggattgtgattcttttcacattattgcatttcaagattatcaaacttgaatggattgagcttggcgcagcatggctcctcggtgagctgctgctgtttttcatcccgtctgccgtcggagtgattgaatacggagatattatgtctaaattcggcgtaagcattttacttgtcgtcgtcatcagcacatttgtcgtgatggtttcaacaggtacgcttacacagctgatagcaaaaagaaaggagaaaaaacaaacgtgttcatcggaatcataagtttattcttaactgtcttagtatatttgggcgcgaaaaaactctacattcgttttccgcgggtgtatacgtcgccgcttctgattacgcccgctgttttggtcgtactgctgcttcttgtcaatgtcccgtatcagacatacaatctcggcggcggactgctgaccgatatgcttcagccggcaacagtggcgttcgccatcccgctttataaatatttcccgattttaaagaaatacgccgtggaaattattttgaacgtagcggtcggttcatgtatcgccattctgtcaacagcctttatcgcaaaatggttcaatctcggcagcagcttagtcgacagtctcgtgccgcgatccgtgacgacgccgattgccatgaacgtttcagaaatgatcggcgggatgccggccgttacagcggttttcgtcattttaacggctttattgggaacgatcatcgggccgatggtcatccgctatttccgcattgataacgaaattgcccggggcgtgctgctcggaactagcgcgcacggagcgggaacatctaaagcatttgagctcagctccgtatcaggaacgatctcaagcgtgtccatgattctcgccgcgattatgacactgtgcgcggccccgattttgctttcgtttatgtcataaaagactgctccttacagagcggtctttttttagttgccatgaagaattgatttgtctgtccttcataaaaagacgaaaacacgatatgataagacatgaagtgaaaagactgaagaacggatgtgtcatatgaacggccagcagcgaagcagcatcagaaaaggacttgaagtcgatatcgtcctgaaagccgatcagcgttcaggaaagctgacaagaggaatcgtgaaggatattttgacgaactcaagcttccacccgcgcggcattaaggtccgccttgaagacgggcgaatcggccgggtgcagcacattattgaatagaaaaaagccggagcttcacgcccggcttttttttctttaatttcagcaatgaaatcctcatatgttctccctttatatacaaaaaatttttaaccaactattgactcttacgttgcgtaatactttagagtagccattaaggaggcggcaaacgtaatgggtatgaaagtaaaagaagtagctgacctgattggagtaagcatacgcactctccatcattacgatcaaattggattattgactcctcaggaaacgaccgattccggttatcggctttattctgaagagaatcttgaacagctgcagcagatactatttttcaaggagctcgatttctccttaaaagagattaaagaaatcattactaatccttcatttaaccgaagggaagcattcattttacaaaagaaaatgttgattgagaaacggaatagagtcaataagatgattgaaaccatcgataaatcaatcaaacatatgatgggagagatttgcatgacgaacaaagagcggtttgagggaattaactttaatgataatctttatgagcaagaagcccgcaaacggtggggtgatcaacctgtcgataaggtaaatattagattgaaaaacatgactgatggtgagcaaaaagatttatctgataagtggactgcaatgttcaataaatttgcactccttattaaccaatctcccgagtccccagacgtacaaacagctatcaaagagtggtttgattttctcaatgaaaattttggtgaatattcttttgatgccttttacggattaggtcaactctatattgaagatgaacgcttcactaagaacatcgaccggtatggtgaagggttggcgaagctcatgagtgatgccattacaatttatatagatactcaaaaaagggtggtgcccattaaaatcattatcgaggatacaattgggcggagggattagtgaggccactttacttggcacagatgagatactaaataatagcgggttttttctttaaacagtaagatatgaagattatttatcccgtattaaagcgatggaagagggttttcttttccccctctttccacgctataaatgatcatcctattttttccgcaagaaaacaaccttcaaatagttcccttctttaaacgccggaatcgttttgaaatcttccggaagcgtgtattcttccaaaatgtcgtaacgctcatttgtttctttaaaggcggtctctataaaacctttaaatttcttcatattgaaggcgctgctgtttgtcgaagcgacgatgatgccgttttttgcggtgatggcgatcgtttccttcagcaggtttttataatctttcgccgcgctgaacgtccgtttttttgtgcgggcgaaagaaggcggatcaaggatgatgaggtcaaacgccagcccttttttctccgcatagccgaagtatttgaaaacatccatgaccttaatgtcatgcgcctcataatcaattccgttggcgctgaactgttcaatcgtttttgcgagactgcggttggcgacatcgacgcttgtcgttttctcagctccgccaagcgccgccgcaacggaaaatgcccccgtataagagaacgtattcagcacccgtctgccgtttgcatacttgtcccgaatcgctttgcgtacatgacgctggtctaagaaaatgcccgtcatcgccccatcgtttaaatccgccgcgtaccgtatgccgttttcttgaacaatgaccggaaaatctcctctttcgcctttgacaaaatcgtcgtcttccacgtattgcccggcagtatcgaatcgtttcttttcatagatcgctttataagaaagctccagtccgtcaatcgcctcaatcatgctgtccttataagcgtaaatgcctttactgtaccattgaatcagcagataaccgtcataaaagtcaatcgtgacgccgccgatgccgtcgccctcaccgttgaaaagccggaacgccgtcgtatcgggcgcgttaaacagatgggctcttgcttcagccgcttttttcagcttgtccagaaagaaacgtccgtcgatccgttcatctctcgcgcgggacagcacccagccgactcctttattctgcaaaccgtaatagccttttccgataaactcacccttctcggatgtcacatcaaaaagatcgccctctgttaaatgagccgagcttccggacagagcgtctttttcaatcagggggaatccttttttcagctttccggcaaatgtatctttcactgtaagtagcttcattgtgcattcctctttcgttttgctttctcttatcgtaccataaaacatgatcaacaccgcattgtcccgaaaaattcaaaacagggggaaaaccatgacagccaaaagaatcgaccatacaggcattatggtcaaagatattgaaacatccatcgccttttaccaagacgttctcggtatgcagttaaaggatcgtatcactcatacgaacggcattattgaacttgcctttctcggctttcaagaagggccggagacagaaattgagctgatccagggctacagcagcgagcttcccgcagaaggaaaagtgcaccatgtcgctttattgactgaagatatcgcagcggagttcacgcatgcgaagcgtcagggcgccgtattcattgatgaagaaatcacgacacttccgaacgggtaccgctacttttacattgaaggacctgacggcgaatggatcgaatttttccagcgttaaaaaaacgggcgaaagcgcccgtttttttttatgtttcttctgtgacgttttgttccgccgcccgttcctctctccatttttgaagatcccaaattcggaaaaacggataataaatgataaatgtaatcaggagattgatcagctgcatgaccgaaccggagatttttccgcccgtcgccaaataaccggaaatcagcggcggcatcgtccacggcacggcgattcccgccggttttgccaccatccccgtgctcatcccgatgtacgtcgccgtaatggtcaagagcggcgcaacaataaaaggcacgattaacagcggattcatgacgagcggcatcccgaaaataatcggttcgttaatgttaaaaatcgcgggcccgatgccgagacggccgagctgtttcatctgtttgcttctggagcgcacaagcatggtcagcacaagggcaagcgtcgctccgcttccgccgacattaatccatatttgaaagaactgtgtcgtaaaaatgctcggcagcgcttctcccgcctgaaaagccaaacggttggcgtccatcgccccgtaccagatcggcgacatgacgccgccgattatggacgcgccgtgtatgccgcacgaccaaagcagcatttgcacgaattcggcgataagacttccgccgagactcccgcccaaaatagacagcggggtgcccagcagatcgcctacgacattgtggagacttttaaaaggagttatttcaataaacagacgggccagccatacaagcgtaataataatgaaaccggggatgagcgcaacgaacgatttgctgaccgcaggcggcactccgtcaggcatcttaatgacgatatttctttgtataataaaccggtacacttccgtagacagcattgcaatgatcatcgcgacaaacagacctttgcttccgagcagcgaaatcggtatgccgcctcccaccataatctctgttgacgagccgtcagggataaacggaatctgatacggcgtcgccaataaaaaggcggcaagggcaatggctcccgacgacagggcatccacctcatagctttccgcaagccggtaagcaatcccaaaggcggcgacaagcgccataatgtcaaaggacgcattcacgggatacccgagcttttcaacccaattttcaccgaaaagaccagccataaaatcggcataaccgggaatcggaagactcgtcagaatcagaaaaaccgatccgatgatgataagcggcatagtcaaaataatgccgtcccgcaaagctcttaagtgcctttggccggcgacttttccggcgacaggcatgattttttcttccatgacccgattgaacgtactcatttatcaaaaaccccctttttgagttcattgcgcagatgtcttaaagcattttctccatcatattttggaaacgcttacatttgcatacagaaattttccttacccctcaggaaaaaaagaattccgcactgccgatatataaagaaaaagggggaatcgcaatgtatcacaccctgaaaccgataatggccgcggccttgtgcatcagcctgttctccgccgcggcgcccgcgcacgccgagacgcatgaccgggacgttatcgtggtgtacaaaaatcaaaacggcaaggaatccgccatagacagcggagcggatgtggaacagacctatcagcatctcccggcagtcgccgtgtcagccgattcgcaaacagtgaaagacctgaaacaggaccctgacatcttatatgtagaagagaatgtatcctttcaggcagcaggcggttctgatatccgcccgttatcagctgcccaaagcagcagttacgtgctgccgcaatgggatatcgaaccgactcaggttaagcaggcgtggaaagaaggcttgacgggaaaaaaggtgaaagtggctgtcattgacagcggcatttaccctcatgatgatctctccattgccggaggctattccgcagtcagctatactccctcatacaaagatgacaacggacacgggacgcatgtcgccggaatcattgcggccaaacatgacggatacggcatcgacggcatcgcgccggatgtccggttatatgcggttaaagcattagacagaaaaggagcgggagatctcaaaagccttcttaaagcgatcgactggtcgatcgccaataaaatggacatcatcaatatgagcctcgggacaaacgcagacagcaaaagtcttcacgacgccgttgacaaagcttacaaaaaaggaatcgtgatcgttgccgccgcaggaaacgacggcaataaaaaacccgtcaattatccgggcgcctacagcagcgtaacggcagtctcagcgtcaactgaaaaaaacgggctcgcagctttttccacgaccggaaaacaaattgagtttgccgcacccggcactaatattacgagcacgtatctgaatcaaatgtacgccacagctgacggcacatctcaagccgcgccgcacgtcaccggcatgttcgcgctgctcaggcagaaatatccggaggaaacaaatacacagctccggcagcagatgcagcagaacgtcaaagatctgggcgctcccggacgtgacagccgattcggctacggactggcgcaatatcacacaaaacaaaagagctttgccgaacgggccgtaataaaagcggaaaagacgaaaaagcaggcagatatcgatgaagcaaaaacggcagtcagcaaactgtccaagtcaaaaggaaaaaccgctctcgaggcgcggatcaataaagttcagacggcaagaaatgtgacggacgcaagagacaaagtccggactgccgaaaaacaaaagaaaaaaaccgccgtcaatgccgcacaaagcgccatccgcaaattaccggccggttcagagaaaaaagggctgcaaaagcggctgaacgctgtcaactcaagccttttgagaactgctgaggccagcgtcaagcaggcggaaaaaaagacttctgaggccaacaccgcaaaagcccaaaaagcagtcagcgaaatccagccgggaaaagaaaaaaccgttctggaaaaacggcttggctggataaaagataaactcaaccggcagcaggcaagggacaaagtaaaaacggcggaaaaaaccaagacgaaaaaagcaaaatcagcggcgcaaacggcagtcagccgattgaagccgtctgccgaaaagaccagcctgcaaaaacgcgtgcgtgcgattcgggtgaaataataaaaaaaacgcttgtgagccggtcaacggcttcacaagcgttttcatcacacctgcctattggttcatggccgggcggtcaatcgtgttccatttcgtaaaggacatatatcggaaataatgatcacgatacgggtgcgaggtgcctgtattccaaggcttgtccccgccgcagaaatggacgatggccggttcggcacgtgtttctctgtaacgtatacggtcgatcagttcaggaggcgttttctcattcatgataatatgcgtctgcgcgttccagcgcggatgcagttcatgccattgatcatataagatcgcgttaagcgcgtcctgatcatgaaacacgagaaaatcctccgagctgttatcattgataaaatcaatcacttttttggaaatattctgttttctccaaggttcgaaatctataatcataataccggaattaaaatacttggcagtgtcgctgatattcatttttttcagtctttcatgctgtccggcatcttctaccgccgcaactattgccggggaaatatccaagtcccataaaaccgaaatatcttccatcacaattgcatcgcaatcgatgtaaatcatccgctttacggactcatccttaattaaatcagggatagaaatgcggtaataagccgcttttgtaatatggctgctttcgactgcatgcttgtattgatcagcgtctacttctaaaaattcaagcggcgtcccgaatgacatcgcagtctgttcaagcttgtccttgttttcggcagtaattccgccgtcgatcacatataatttggcattccttgttttatccatattcatcaataaagaagcgaacatcccacccaaatgacgagcataattatcatcggcacatgatacgatatgcattgtttcattctttcccactgatattcatctccctttttgttgtacaaatgtctttccctttttttaaaaagtaaacctcaatcttacacattttttctgcgggaatgtgctgtttgcgatttgatatctttcgcattctctgttaaaattcatttcatagctaatgattctgacaataataaggagcatgacgccattgacgattcgcaacgatgccggatcagacaataagaagccgaacaggcctttttccgatctatccggccgaaacaaagaggcggcctatattgcagctgcactctatcggtccgcccagcagctccgtgtaaaaatggagaaagaggtgctgtcggcacacaaattatcatggacggcgttttccatcctgtatgacctttgtgaatgggaaacgcttgatacaagaaggatagccgctctatccggaattacctcggcgacggcgagcaatgtcctgaacactttggaaaagaagggcttatgcagcagacaaacgaacaaaagagaccgcaggcttgtattcgtcagtattaccgatgagggcagaaaggttattgaagatctgtaccccgactttcatcagggggaaattgaactgacggcctgtctggataaacaggaacaaaaaacgctgtccgccctgctgcaaaaaatcgctgacaatttcataacatagcagctatgacgggaatcagtaacggattgtctccctgtttcagagagccggcggatggtgcaagccggcacaaagacaaacgtgaattacctccctgagctttctttgtgaacttcagtagcaaagaacgggaaaccgttattcgaatgagcggaagacgtcgtttcgtcttcaatcagggtggtaccgcgtgcatacagccacgtccctttttgggatgcggcttttttgtttggctaaaaaaaggaggatgtaaaagatggaatcaatcactttaacgaatgatcaggaaaaagaagtgcaaaggcagctggatttgtacatgaccggcgccgcggacgtcataccgcctgaagaattgagaaataaaatcgccaaatcagtggcatccggcaagccgctgaacattaaactcggccttgatccgtccgcacccgacgtccacttgggccataccgtcgtgttaaacaaactgcgccaatttcaagaaaacggccatatcatacagcttgttatcggggactttaccggaaaaatcggtgatccgacggggaagtcgcaagccagaaaacagctgactgatgaagaagtccaacacaatgccaaaacctattttgaacagtttggcaaggtgctggatcaagacaaagttgaacttcactgcaactcaaaatggctgaagacattgaatctggaagatgtgattgaattagcggggaaaattactgtcgcccgcctgatggagcgcgacgactttgaggagcgcatcgccatgcaaaaaccgatctcacttcacgaattcttttacccgctgatgcagggttacgattctgtcgttctcgaaagcgatatcgaactcggcggtacggaccagcattttaacgtgctgatgggccgccatttccaagaacgctacaaaaaagaaaagcaggtcgtcatcctcatgccgcttttggaaggtcttgacggcgttgaaaaaatgtctaaatcaaaaaacaactatatcggcattgacgagcatccgaacgacatgtacggcaaaacgatgtcattgccggacagcctgatgaaaacatatatccatttagcgacagacttagagcctgcggagaaaaaacagatggagaaggatttggaatcaggaaagcttcatccgagagatgccaaaatgatcttagcgggtacaatcgtcagaatgtaccacggcacgaaagcggcggatgcggcagagcggcatttcaaacgtgtcttccagcaaaacagcctgcctgaagatatgaaaaccgtcatatgggacggagaaaagaccgtgccccttattgagctgcttgtcacgcttggactcttttcttcaaaaagcgaagcacgccgtatgattcaaaacggcggaatcaaagtgaacggggagaaaacggatgcccttcataccgtcattaccgcagaagacggcatgacgattcaggtgggcaggcgaaaatttgtacagctgcgcataaacggataaacaaccagccggactgcgtataatagcggtccggctggttgtgacgggtcaatcgtttaatcgacttctttcttaatcccaagcatcttttcgtctaaataatgggcgatgtccgccgcttccttcagctcgtcggtcagatgctttgggacttcgttatttaatttgtaataaattttgtgttcaaggctcgcccaaaaatccatggcgatggtgcggatttgaatttccgccttcacatattccacacgattcgtcaaataaacgggaatttcaataatcaaatgcaggctgcggtagccgttcggcttcggatgtttgatataatccttcacctttacgatcttcaggtccttatgctgcttcagaacctcagcgacattataaatatcggaaataaaggaacagataatcctgacacccgcgatatcatgaatatgctctttcatttcctgcgtcgtcacatcgcagcctttgcgcatcagtttattgacgatgctttcaaaacttttcacgcgtgattttgtatgctcgatcgggttatgcccgtgaatcagattatattcctggctgatgatagaaaacttcgtatccagctcatctaaagcgaatttataaactaataattcatttttccaatcttccatgaccgtttttaaatcatccatatgggctgttgacaagtccatttttttcatctccttgctttgctgtccatatatgagacgggtcagtccgcggtcaggttctttacaatatcgtgaagattatgtcataaaaaaaagcaaatgccggttatagcatttgccctttcatttgatcagcggaaataactgatcaggagtccgattgaaagcaggaatccgaagaatgtattggtttgcgccgttgatttcatcgcaataatcatgttcatcggcatttcgtttttcacaaagcctttcacggcctgaacgggtttcggcacgctcaaaaagaccaggaacagccacgggcttgtgtaacccatgatgacaagaccgacgatccagatgtaagcgatggcaaaagatgccgccagtatcataacggcccctctatgccccatcaaaatggccagcgttttacgtccgccttttttatcttcctcaatatcacgaatattgttggacaggttaatcgctccgaccaggatggcgatcgggatggaaatcaaaatgctctgttcattaattctgcctgtctgaatgaaaaaagaaataaggacaaatacagagcccatgcaaatgccggagaacagttccccgaacggtgtatacgcaatcggcagcgggccgcccgtatacagatagccgatcagcatgccggcaaggccgatagccgcaagccaccagctgctgctcatgcagatataaacaccgagcacgagagcaatcgcataagagccgagcgccagctgcagaattgttttcggcttcatgccgtggcggacgatcgctccgccgataccgacggaatcctccgtatctaaaccgcgtttaaaatcgtaatattcattgaataagttcgtggcgatctggatccaaaggcaggaaaacagcatggccaaaaacagcaggaaatcaacctttacgtaaaacatcgccaatacggtgccgagaagtacgggcacaaacgatgccgtcaatgtatgagggcgggttagctgccacaaaatgcggcccatgctttctttctcgggcgtcttttggctgccccccatattgttttgattcattttcctcttcctttctattaaaaggctttcacagtcagccgataacagtagtgttgaattggggttttcacgttttctgctaccttatctatcataataatttcttcctcatttcacaagatgcggcgctttatcagctatcctgccggaaacggcttttcgcccttctcccttggggttcggcacaagcctgcttaagaaaaagccgccaaaatttttttacctcgtttatatttacgataagttaaaaatcccgcctgaacagcgcctttttagtatgatcatttgccaatttatacatgcgtgttttccatccttttgtttctcattcatttttaaggaaattttaagcttaggatattagacatattttgaaactttttgttaatctaatcgtcatatactggtgtaattattgaatacgcggggaaggaattttgaatatgatgcaaaaattaaaacgtgcttatgaaaatacattgatcaaatggacgtttcatacgggcttttattttctgatattagtattgctcttttggatgtatggatttcatacagcgaataccggcacttatatttacaacgatttctaatcggggaggataactatgaaactacttgatgctataaaaacatacgcagacgccaagccgcaggccgaagcgtttcgttccttagatcattccctcacttacggggaattatgggatttgtcggagcgggttgcgtccggcattcaaaaacatacagctgacggttcgaaagcgcctgtcctggtttacggacatatggagccgaatatgattgtttctttcttgggaagcgtcaaagcgggccgcccttacatccctgtcgatgtttccattccggcggagcggatcgtcaaaatcattgaaagctcaggcgcagagctgcttatcagcgtatcgggcgatgcagtcgatacgggaagcaatctgattaaaaccgttacgcccgaagagcttgcagctgacggagatgcagacctcagccgtgagaactgggtaaaagagctggatacgttttacattatttacacgtccggcagcacgggaaatccgaagggcgtgcagatatcggctgataacctgcaaagcttcactgactggatctgcagggattttcctgtgggcggggtaagacattcttaaaccaagctccgttttcttttgatttatctgtcatggacattttcccgtcgcttcaaacgggaggtacgctgcactgcgtaacgaaagacaaaatcaataaaccgaaagtactatttgaagagctggagaaatccaaactgaacgtctggacatcgacgccgtctttcgtccaaatgtgtctgatggaccccggctttacgcaggagctcctgcctgaggcagaagtatttatgttttgcggagaagcgcttccggctgccgtggcacaggaactgttaaaccgttttccgaaggcccgcgtattcaatacatacggcccgactgaaacaacggttgccgtcacctccgttgaaattacgcagcagattatcgatgaaaatgaatctctgcccgtcggttttgcaaaacccgatatgaatatcttcatcatggatgaaaacgggaataagcttccggacggagaaaaaggggaaatcatcatcgccgggccgagcgtgagcaaaggctatctcggtgaaccgtctctgacggaaaaagcgtttttctcaattgacggccagtgggcatatcacacgggtgatgccggttatgttcaggatggtcagattttctgccaaggacgccttgatttccagattaagcttcacggctaccgcatggagctggaggaaatcgaagtacatgtaaggcagtctcaatatgtgcagacggcggttgtcatcccgtatcagcctaacggaccagtcgaatatttaattgccgccatcgtgcctgaaaaacatgattttgaaaaagaattccagctgacaagcgccattaaaaaagaactggccgcttcgcttccggcctacatgattccgagaaaattcatttatcaggatcacattcaaatgactgcgaacggaaaaatcgaccgtaaacgcattggcgaagaggttcttgtatgacgccttacagctcgtttttcttctttatcttacttggaatccttcttttgccgacgattattttagggctgaacggcaagagattccaaggatacaacatgtttatatccatcatcgtattggctttgattttcgcgcatgatctgcacggcgtgatcgcactatgtatctttacgctgtggcaggtgcttttaatcaggggttatctcgcttacagactgaaagccaacagcggctttgtcttcagtatggccgtgatcgcgtccattttacccctgtttttatctaaattatggccgtttttcttcccgccggcgcctcatcatccggttcataacctgatcagtttcttaggaatttcttatttgacatttaaaggcgtccagctgatcatggaaacgagagacggactgattaaagaaaaaatgccgcttcaccgccttttgtactttattatgtttttcccgaccatttcttccggtccgatcgacagataccgcagatttgccaaggacgaacagaaagtatggacaaagggagaatacgctgatttactgtataccggcattcataaaatttttatcggtttcttgtacaaattcattatcggatatgcgattaacacgtatttcattatgaatctgcctcatatcacccacagtaaactgtggggtaatgtgctgtacatgtacggatacagcttgtacctgttttttgattttgcgggttacacgatgtttgccgtcggtgtaagctatatcatgggtatcaaatctccggaaaactttaataagccgtttatcagcaaaaacattaaagacttctggaaccgctggcacatgtccttatccttctggttcagagactacgtatttatgcgctttgtattctggatgacaaagaaaaaatggataaagaaccggatggccgtctcgaacatcgggtatttcctgctgttcatgctgatgggcgtctggcacggactcgccctgcaatatattatatacggcctttaccacgccgtattaatgaccgggtataacttttttgagaaatggaataagaaatacaagtggctgcccgccaatcgttttacggcctttttagccatcgtcatcacattccatttcgtatgtttcggattttatattttctcaggaaaaccatttcatcactaaaggagattgaaaacacatggaatttaaacaggaagtattagacgtattagctgaagtttgtcaggaggacgctgtgaaagaaaatcctgatattgaaatctttgaagaaggactgcttgattctttcggaactgtagaactgcttgtcgccatcgaaaaccgcttcggcattacagtgccgatcactgaatttgaccgtgacgagtggaatacgccaaacaacattgtaaacaaactgactgagttgaagtaaatgaaaaagcgtttctttggaccaattattttagcgtttgtcctgtttgtcggagctatcgcagttccggcttcatggcttacgcgcttcattcctgaaaaacgtgtcgaagagtcggcagcggccttaaatccgaatatgttccagggcctctatctgcaaaacaaaatgttcgaagactcgaagtatatgccgattttcggttcttccgagctttcaagactggatgagtttcacccgtccaactatttccaagtgaacaaccaaggctttacgccttatcttgtcggaaaaggcggggaccaatccttgatacacgccgtgaactttgcggcgcattatcagcagctgaagggcaaaaagctggtattcattgtttctccgcaatggtttatcaaaaaaggttctgatgaacagcactttgcgccgaatttttcatcacttcaggcattggatttagcatttaataaccagattgatcccgcggtcaaaaagaacatgatgaagcgcatgctccgttttaaagttgttcagcatgatgccgtcctttctgaattatacaagggaatggtcaacggacaatcatggaaagtgaaagcggtcatgccggctgccaaagcttattattctctgcttgagaaaaaagatctttattattcaatgggagaaaccaagggccctgaacggacgatctctgaaaacctgaaagggaaatcgtggtcagagttaaaaacagccgccgctcaattaggagaacggagctccaagtccaatcctttctatatcgatgacgcttcttataaaaagattaagaagaaagtaaagagagtgaaaggaatcaacaaaggaagaacgtacgccaaatcagtcgaatatcacgactttgaggatatgctggacattctgaaagatgccggcgctgaaccgatgttcgtagttattccggtcaacggaaaatggtatgactacaccggcttcccgaaaaaaggccggactgattactacaaaaaagtcactaagcaaattaaagcgaagggctttcaggttgccgacttatccgggcacgaatatgatccgtactttatgaaagacaccatccatatcgcctggaagggctgggtgtacgtcgataaagcaatggagcagttttacaaaaccggcaaggtgacggttcactgagcacgatgattacagaatatgtaaaaacgaacacgcagggggcattctctcccctgctttttatgtgatttgattttttcacaaatttgaggaaaactattgcgaatatttgttgaaggtatacaatagaatataaattattttcaaataagtttgacaataacaccaatagggagacagaacattatgaaacaagacattcgtgttgaattgacttcagccaaaaaaccgaaaccggacccccataaccttgcgttcggcagaattttcaccgaccatatgtttgttatggattacgacgccgatcaaggatggtatgatccgagaattatcccttatcagtccatctcaatggatcctgcggccatggtttatcattacggccaaaccgtttttgaagggcttaaagcgtatgtaacgaaggatcaggaagtgcttctgttcagaccggagaaaaatatggagcgcctgaaccagtcaaatgaccgcctttgcatcccgctcattgatgaagagcttgttcttgaaggcctgaaacagctcgtagccatcgaccaagactggattccgaaagcggaaggcacttccctttatatccgtccgtttattattgcgaccgagcctttcctcggtgtagcggcatcccatacgtacaagctgtttatcatcctttccccggtcggctcttattacaaagaaggcattaaaccggtaaaaatcgccgtggaaaacgaattcgtgcgcgccgtcaaaggcggcaccggaaacgcgaaaaccgccggcaactacgcatcaagcctgaaagcgcagcaggttgcggaagagaagggattttcccaggttttatggcttgacggcattgagaagaaatacatcgaagaagtcggcagcatgaacatcttcttcaaaatcagcggcgaaatcgtgacgccggagctgaacggaagcattcttgaagggattacgagaaattccgtcatcacccttctcaaacattggggactgactgtgtctgagcggaagatttcgatcgatgaaatcatccaggcgcatcgtgacggccgattggaagaaacattcggaaccggtacggcggcggtcatttctccggtcggcgaactgatctggaatgatgaaagtcttgtcatcggcagcggtgaaaccggagagatctcgaagaaattgtatgataccattacaggcattcaaaaaggcgcggaagccgacgtgttcggctggacggcgaaagtcgcctcactaagcgaatcaaaataagcaaaaaacccggaagcgaatccgggtttttttactgctcttatgcttcaatcgacttaaagaaatggggcagatgttctttgtgggcctcaagcatttcatccagaatggcctttgccacggagtctgacgggacaagagggttgatcgtcatcgcaagaagcgccgtttgataatctcccgtgacggctgcttcagcggcgacgcgctcaaatgatttgatttgctggacgagtccgcggacagacaccggcagatcaccgacggcgatcggtttcggaccgtctttcgtcatgacgcagttcacttcgaccgctgagtcattcggaatgctggcgatcgcgccgttgtttatcgtattgacgggctggatatcatgtttgtcgttatagatggagctgatcaggttgcaggccgcgtcactgtagtacgctccgccccgtttttccagctgcggcggtttgatggcgagattcggatctttgtacagttcgaacagttctttctcaaccttctgcacgacctcggcgcgtgtgccctccgtctgtgaagcttctatttcatgctcgagcatttctttcgttttgaaataatagcggtggtagccgcaaggaatcagatcgagcgccttcaggaattcaggctcccattccgctccggaaatgtttttcatcgtcatggcgttttccgggtctcccatcgcttcgatgacttgatccttcacgctgacgccgtctaagaaaacatctaacccgaagaccatgtgattcagtccggcaaattgcacttcgatccggctgacatccacatccaatgcttttgcgacgcccattttaatgccgatcggcacattgcagaggccgacgacttttgtgagattcgagtagcggagcaaggcctcggtaaccatgccggcagggtttgtgaaattcacaagccacgcattcggacaaagctcttcgatgtctttcgcgatttccagaataaccgggatggtgcgcagccctttgaataaaccgcccggaccgtttgtctcctggccgattacgccgtattttaacggaatccgttcgtctttggcgcgggcctcaaggagaccgacgcggaattgagtcgttacgaaatccgcatccttcaaggcttctctccggtcaagcgtcaggtgaatctctatcggaacacccgctttttcgaccatgcgttttgcaagcgtgccgacgatattgagttttttctcgccttcgggaatgtcgacgagccataattctctgacaggcagttcctcatagcgcttaatgatgccttccacaagctccggtgtatagcttgaacctccgccgatcgttacaattttaattctttttgtcatatttttgctcccccttgcagactcactttttcgtaaatctcgactaactcagcggccaagtctttcacggtcatggcattcattaaatgatcctgcgcatgcaccattaaaagcgtcatgtctgttttttctccgccggcttcattttggatcaattctgtctggtaatgatgggcttcggtcagttcccttgcggcttcctgaagcttttcctcggccatggctctgtccccctgctttgcggcggcaatggcttccattgatgcgcttctgccgttgccgccatgcaggatgatctgaaaaatggtctgttccattttttcattcatgtgtttcactccctttctctacagcacggctttttcgtctccctgtacggctggcgcctgcgattgttcaagttcgttttcttctttcagcttttgcgaatcccacattctgaagaacggatagtacacgataaaggctgtgatgatattaatcgcctgcatgacagcccctgatatttttccgcccgtggcaagatagccggagaaaatcggcggcatcgtccatgggacggcaatgccggcaggtttggcgacgaggcctgtgctcatgccgatataggtaaagaccagtgtgacaagcggtgtgatgatgaacggaatgagaagcatcgggttcatgacgatcggcattccgaaaataatcggctcattaatattaaagacagccggcccgatggcgagtttcccaagctgcttcatctgcttgcttcgcgaacggagaaacatggtgaccacgagcgccagtgtcgcgccgcttccgccgatgttgatccagatttcaaagaactgctgggtgaaaatattcggcagcgcatcgcctgcctgaaacgcaacacggttggcatccatcgctccgaaccagatcggcgccatgacgccgccgacaatgttcgccccatgtaatccgcacgcccacaaaagcatttgaaccgcttcggctaccaggcttccgccgagacttcccccaagaatcgagagcggcgtccccagtacaacgcttacaatgttatgaaggctttcaaacggcgtcgcttcgacaattaaacgcgcaccccagatcagaaagatgacggcaaagccgggaattaaagcgacaaatgatttgctgaccgccggaggcacgccgtccggcattttgaagacgaaattccgctggatgatcaggcggtaaatttccgtcgacagcatggcgatgatcatcgcgacaaacagccctttgcttcccatgagagacagcgggatgccgccgcccaccatgatttcctcttttgcgccggaaggcagaaacggaactttgtacggcgttgccaagagaaacgccgccaaagatatcgcaccggccgataatgcgtccaccccgtatttttcagccaggcggtaggcgattccgaaagcggcgacaaggcccatgatttcaaaggtcgcatcaaccggatattgcagtttttgagaccaggcgcttccgaacgtcttcgccatgaaatccgcatatcccggaatcggcaggttgccgatgatcagaaaaaatgaaccgatgatgataagcggcatggtgaggatgattccgtcacgcagtgcttgcagatgccgctgggaggcaatttttccggcaatgggcatgactttctcttctaaaaactggttcaccttattcacacggcccgcccctttctacgatgcgtttccgagctgttccgctgatttcagaacctccgctccgttgcaagtgccgtaatggacggtattgatgacttcaaccggcactccttttgattcacccaattttttcagctgcggaagcaaataacggacttgaggcccaagcagcaatacgtccgctttatcaatatgctggttgactgaatcgcctgacaccgcccagattttatattcttttccttgttcctgcgcgcttttttccatcttggtgacgagtaagcttgttgacatccctgctgcacaaacgagtaatatattcatgtaaaagacctcctgaaagtttgatattttgtatgtctcgatgttagtaacatcatattatgaaatcgctttcataactactcaggctttttccgctgctaacggaaaaaaggtgtatcccggtctttctctgatcgtttgtctctgaatactcgtaaaacctcctgataggttgtgcattttaagagacggcttaccgcggccggatcatccaacatgccgccgagccatttgtacatatgctggaggtcggctttgctttctttctcgacgcagagcaggcagacaaattggacacgcttatccgcccagtcaatcggcttcttcagcgtgcataccgcccaaaacgtcgtgtctgtctgcggaacgagcgggtgcggaatcgccgtaagattgccgaaactcgtaggagaaatcgcttccctttcaaaaatagaatcggtcagagaatcagaagcgaggccggcttctgcaacctgctgtccgagaaaacggatgacgtcctccttcgtctccagatcctgctgcaaaaataccagctccggtttcagaaagttcaattgttcccgattttcttccagcatggcgtcgatttttgtaaaatccccgccgcccagcagcgtatgaaccttcaatacgggaacgggcaggtcttttttgatcggcactgtgctgaccacaaaatcaatcgactcaaaggaaagctggtcaaggctgcagtaatcagccgttccgacgatttcaagacgttttgcgaaccgggaacggagcttttctcttaaaagctgcgcgctgccggcgccggacgcacagacaatcagacagcgtttaggcggccgttccgtctttctcctttcaatagcggctccgaaatgaagcgccaaatacccgatctcattttcatgaatatcaatgccggtttgctccttgatcacgattcccgcaatcactcccgcttcaaatgcgagcggataattctcctttatggcggagagcatcgggtttctcaggttcattccgtaccggtttcggttaatcgccggcttgatatggagcgcaagacccgctttcagctcattgtcgtccgtgattccgagcttcagctcccgctcaatggcttcaatcatggcctccgtcaaacggctggtttccccgtctatcagccttgtaagctcttttccttccatttgtgactgggtcatgcgctttgtcccgagcaggtgaatggcgatataggcggtttcctgttcgggaaaggtgaccgaaagcgcagattcaagctcttttacgatggcttccgctgactgatattctgtttcgagcttaatatcatgaagatcttccggaatgagagatacatagttttctgtccggattcgtttgcaggcaatggcgatatggatgatgagattgttcaggccgaagaaagaaagcgggatcttatggtttcgaacctgcttcataatggctgtgcggatcacatgaatgtcgtctttcggcagaataccggccttttcactcaggagatcaggctcgggctcgcggtcgtccactaagtattccgccatacaataacggaggcggagctcttcgccgcgcagcttaaagccgtagttcggccttgtttccaaaatgatgtcataggggcggagccgttttttgacttcttttaaatcagattgaagtgtggatttactgatgaacagttcttccgccaagtcatccagcttgaggtagccgtcggccagaagcattcttttcatcaggtaatctatccgttcatcgggaaaaatcggtacggtgctgttctgctggaaattgtcctgaagccagtttttaaacggctgctcattccggatcagcagcttatagccgctccctctgacagattgaatggatgcgccgtgtttttctacaatggtttgcagttcctttatgtcattgcggaccgtccgcgtcgttacctttacatttgcagcgatgactgagcttgtaaccggtgtttcagcagctaaaagcaagcgcagaagttcacgaagccgcccatgaagcatgagaaaaacctcctatcagatcagatgcagatgtgaaaaatgggcaaaaagaatgaggaaggggtaaatgtatgtaaattctatactggggaggatttcaagtcaatgcggcaatccgatgccaagaccgtaaaaaaacagccggatcagccggctgttcgggatgcggacatgcggttccgcttagatgccttccgttcttttatgatttttctgataatcggatagatgacgggcgcccatttgataatcgttttgaaaaattttttcaatgtctgaatcccctttcttttaccttgtctttcccctgttatcagcgtttataaacatggtcagcgtgagacataccggttccccgtcacccaatagcgccacggataatcccgggcttctccgctgttgtcaatcccgattctcgggcctgttgatatatgttcaggcgtaaagccctccgtaatatacagcggcggttccgtgatcatgccgccgtagtcgttcattgaaatgcccatcgccttcgtcagttttcccgggccgtttgtccactctctcggggtctgcccggtctcctgctctccatcaggaactgtccttcatgaggctccgccgccctgattaacacggcctgcggaatgccgatgtccgaggcgacgacgttcattaatgtatgagtgtgcatgacgtatgtataaatgcggcccgcctcatggaacataatttccgtccgtttcgtgcgccggttgccgaaactgtgcgccgcccggtcatccgctcccatataagcttccgtttccacgatataacctgaagccgttccctcatccgtctccttcacaaggagacagccgagcaataaaggggcaagctccactgacggtctctggtaaaattcaatcggcaaaggctttccttctcccgccatttgcctccctcctttctgaatatagcgatttcctctttcacgtttttcacttcttttttacaatataaacatgaaagaaaaaagggcatcattgttgaacactctattgcgttttgaaaatcggcccggtataatatgatggttcaaatgaaaatgattctcatattcaataaatgccggacaatgatcataaaagtaggtgaattgatttttgagcgattctgtcacgtccgcaagccgtctgatcagcatcttaaaaaacggggttttcttcctgatcgcggtgatcgggctgcttgtttctatttttttcgccgtctcattcggcgcgaaagacattactttacatacggtttggtcggctgttgctgattacaatccgaacataacgggccagcagatcattcatgaattgcgtcttccgagagtgctcggcgcggccgttacaggagccgcttttgccgcagccggcgccctcatgcagggtgtcacgagaaatccgcttgccgattcgggtgtcttaggcgtaaacgcgggcgccatgtttgttgttgcgctcagctttgcttttttccctcatttgtcatacgccctgctgatgatgatgtcatttttgggagcactggcaagcaccggcttgattttctttatcagtgcggcgggaaaaggcagcatgacacctttaaaggtgacgcttgccggggcggtcgtggccgcgcttttacattcactcagtaccggtgtagcgatttattacgatttaagccaggatttggccttctggtacgccggcggggtgtcggggatcaagtgggctcatttacaagtccttgttcccgtgattgcggtcttcatcattctcgcgacattcatgggccggtccgtcacccttctctcaatgggaaatgacgtggcggcgaatttaggggtgaacacggctctgacgcgtgccgcgggattaatgatcgccgtcgttcttgccggtgtgtctgtttccgctgccggcgcgatcggctttgtcgggctggtcattcctcatatcgcccgcaagatcgtcggcgttacgtacaggctgattattccgatgtccgcgttgctcggcgcgattcttttgattttggccgacttggcctcacgcacggtcagtcccccgagagaattggcgataggcatcatggtggcacttgtcggtgtccctttctttctttatattgcccgcaaggaagggagagacttataaatgaaagtgcagaaagaaacaaaaaaagcggcggcggcaggtctcgttctgctggtcatcgccgtttgcattattctgatcgggctgcacacgggctcattccggctttctcccctcaccgtgggaaaaacgctgttcggttacggcacgtttcaaagcacaaccgttttattcgattaccggctcccccggatactggtgacgatgctggccggtatcggcttaggcgtgtcaggcgctattttgcagggtgtatcccgaaatccgcttgccgatccgggcattctcggactgcatgccggcgcttccttcggtttgatgatgtatatcacattctttcattccctggaggcgcaggcgtcgatgttcatcccgctgtttacgtttgcgggcggaacactcgccgccctgctgatcgtagtgcttacgtacgacaggctgaacggttttttaacgatccgcatgctgttggtcgggatcgccgtttccgcgggcttcagcgccgttacattgtttatgtcgctgcgcctgaatgaagaaacttataccttcgcttcccgctggctggtgggaaacgtctggggcagagattggattcacgtgtggtcgcttttgccctggatcggcattctcgcaccgcttgcatggcttaacgcccggtctttgaatattttaatgctcggtgaccaggcagcggcggggctcggcgcacacgtgcagagaaaaaggatcatgctgatcgccatagcggtcggcttgtcctgcgcgagcgtcgcgatggccggcggaatcggctttatcggctttgccgcccctcacttggcaagacggctcgtcggcaccatgcatcagcatattattccgattgctggattaatcggccttgtcattcttgtcgcggcagacaccatcggccggtctttgtttcagccgaacgccattccggccggcgtggttgcggcagccatcggcgcgccgtattttctctatctcgtcatgaaaatcaaatcataaaacaaggagtattcccatgaaaaaaataattgcgctcatcagtttcatgtgtattttcttactggctgcctgccaatccgattcatcacagccggagtcaaaaaagaaatccggcgatcataaaatcgcttcgatgtccattcacctgacaaatgatctgctggctctcggcgttacacctgccggttccgtcgtgggcggagaattaaaagattttctccctcatgtgaaaaatcagctgaaagacacgaaaaaactcggacctgcctcagacccggatatggaagctttacttgagctgaatccagacaacatttatcttgataaagaatttgcgggaaaagatgtgtctaaatacaagaaaatcggaaacacacacgttttcgaccttgataaaggcacatggcgtgatcatttaaaagacatcggaaaaatcgtcaaccgtgaaaaagaagcgaaaacatttattcaagattacgaagatgaaacaaaacaagtcagatccatgatgaataaggaattagggaaaaacgccaaagtcatggcgatccgcgtgaacgcaaaagagcttcgcgtcttcagcacacgccgcccgatgggaccgattctgtttgacgatctgaagctgaaaccggctgacggcattaaagaaatgaatacctcccgcccttatgaagtcatttctcaagaagtgctgcctgattacaacgcagatgcgattttcgtggtcgttaacagagacgacaagtcacagcaagcctataaagaattgcaaaaaagcgctgtctggaaagggcttaaggccgtgaaagcaaaccatgtctataaaattgccgatcagccttggcttgattattcggcactgggaaataaattagcaatggatgaagcgaaaaaactgttccaaaaataaacatgagccggttttgcaaaaagtgcaagaccggctttttttatattgccgtttacttatataaatgtctgcttatataatagtgtaaaaaaggagtgagcgcatggaacggcggcataatgctttaagttccgaagggatcagccagtgcctcaaacttctaagcgacccgacgaggcttttgatgctgaagcttctggaggataaggaatattgtgtctgcgagctgacggctatttttcatataagtcagcccggcatcagccagcacttacggaaattaaagaacgccggccttgtgcgcgaaagacgcgagggccagtggcggtactatgccattcatccgtccggaccggaatacgcgctggtttgctcgattctgcagcagatagatgaaaaggacgaagttttacagacattgcggcaaaaagaagtcactgttacatgccggtaagggggatatattcttgggagttgcggttttatcagcgctgatttttgtgctgacacttgtgtttgtcatatggcagccgaaacatatatcaatcggctggtctgcctgcggcggagcggtcctcgctttgatcgccggagcagtcagcctgcacgatatcgcggaagtgacggggatcgtctggaatgcgacactcgcctttatcgccattattatcatttcattaattcttgacagtatcggtttttttgagtgggccgcgctgcatatggccatggcggccaaaggcagcgggctgcggatgtttctctatgtgtcggtcttaggggctgttgtctccgccctgtttgccaatgacggagcggcgctcattttgacgccgatcgtactggcgatggtgcgggctttgaatttacctgaaaagctggtttttccgtttattatcgccgggggattcatcgccgacaccacctcgcttccgctcgttgtaagcaatttggtcaatattgtatccgctgattactttcatatcgggtacattgaatatgcaacacgcatgctggtgcccaaccttttttctctggcggcaagcattttggtgctgtatctctatttcagaaaaaacattccgaaacggtatgacaccggtcttgtgaaacatccggcatccgcgattaaggatgaacgccttttccggttatcgtgggctgtgctggccgttttattgatcggatatttcgtcagcgaactgctgtcgatacccgtttccttcgttgccggctccatcgcggtcatttttctcattctggcgcagcgaagccccgccgtccctgcgaaacaagtcatcaaggacgccccgtgggccatcgtgtttttttctgtcggcatgtatgttgtcgtgtacggcttgcggaatgccggactgacggatcttctttctcagcttattcagaaagcggcggatcacggattgtttgcgggcacactcggaatgggttttatcgctgcgatcctctcctccgttatgaataacctgccgacggtgatgattgacgccatagccatcaacggaacggacactcacgggctgctgagagaagcattgatttacgcgaatgttatcggttctgacctcgggccgaaaatcacgccgatcgggtcgctggcgacattgttatggctccacgtgctgagccggaaaaacgtgaaaatttcctggggaatgtatttcaaaacaggtctgatattaaccattccgacgttattcatcaccctgatcggactttatttatggctgttatggctcgcttgagatgaaaaaccttttaagttgaatcttaaaaggtttttttgtgtcaaaaatccgaaaagtaaaacttttatattttaaaagtatagacatttaatttcaaaagattataatattcatgaaaacgttttaactttatgaaagaagggattcctcatgaaaagaattttattagcctgcagctcaggcatgtccaccagccttcttgtgacgaaaatgcagaattacgccagctccatcggtgaggaggccgagatttgggcagtcggacaggataaagcaaaagaagcgatgaaagacgcagacgtcgtactgatcggcccgcagatgagttttttaaaaggcgagcttcagaaagaggcggacccgcttcacatcaccgttgatgtgattgatatgatggcatacggcatgggagacggcaaaaaagcatacgaacaggccgtttccttgatagagaacaaataaaggaggcgataagcatggaaacgtacacggatgaacagatcagttttcagctgattcttcacagcggcaatgcccgcagctgtattattcaatcgatacgcgcttataaagacggccggccagatgagtcagacacctttctgacaaaggctgaagaagaactgggaaaagcgcacgacatccattttcagatgattcaaaaagaagccggcggcgccaagacggatgtctccctgctttttatgcatgctgaagaccacttaatgtcagcgctctcaatgaaagagatcgtcaaagaaatgctcgacttatttcaatcaaagaatttataaaaagccgggggtgaagacgtgtttgagaaaatcagccaattccttgttccgatcgcgggcaaattaaacaataaccgctacctgcaagtcttacgggatgcttttatgctggcgtttccgctgaccattttcggttcggtgttcgtcgtgctgacgaacctgccgtttttaaacaaaatcatgagcagctccgccctgtctgtctttcaatccggatttggcggcgcttcgacggcgacgatggggattatgtccatttttgtcgtcttcgggatcggctattacctttcaaaaagctacgaagtggaggccgtattcggcggagcgattgcattggtttcttttctgctgctcaccccgttcgtcttagagccggaaacgggcaaagcggtcgcaggcgtcattccggttgaccggcttggagcaaaagggatgtttctcggcatgataaccgcttttttgtcgggtgaaatctacagaagaatcgtccagagaaacttaacgattaagatgcctgccggtgttcctccggctgttgctaaatcgttcgccgcattgattccggcttttatcacgcttaccgtcttcctcttgatcaatgcggctgtcacccagatctttcacaccaatctgcatgatgtcatttatcatacggttcaagccccgcttgtcggacttggaagcggcatcattcctacattaatcgctgttttctttattcagattttatggtttttcggacttcacggacagatcattatcaattccgtgatggacccgatctggaatacattacaggtcgaaaatttggctgcgtatacagcgggaaaagagattccccatattatttctaagccgtttatggagatttacaccgtcggaatgggcggaaccggaatgacattggccatagtgatcaccatcttgctttttatgaaaagcaaacagatgaaacagatatccaaactcggtctcgcgccgggcattttcaacgtcaatgagccggttattttcggtttgccgatcgtgatgaacccgatcattatcattccgtgggtgatcgcaccgatggttgtcacgctcgtcacctacctggccatgtcggcggggatcgtgccccctcctactggcgtgaccgtgccctggaccgtcccccttttcattaacgggattatggcgaccaattccgtcatgggcggcattatgcagctggtcaacctctgtattgtgtttattatctggttcccgtttcttaaagcgctggacaaattaaacatggcaaaggaaaaagaagccgaggccgagcagcaagcacgggatgacagcatgagtatgtaatcaaaatcgcagtaagggagagaaatcaattgactgaatcaaatattcaatatcgttttccggaaggattctggtgggggtcttccgcctccgccacccaaacagaaggcgccgccgacaaagacggaaaaagccaaaacatatgggattactggtatgaaaaagagccgagccgtttttttaacggcgtcggccccggcgacacgtcacgtttttatgatcaatacaaggaggatatccggctgatgaaagaaatcggccacaactccttccggctgtctatttcctggtcaagattgattccggacggaactggcgaggtcaatcagaaagcggtcgcgttttatcaggacgtcatcgatgaaatgcttgcccatcgcattgagccgtttgtcaatttgtttcactttgacatgccgctcgcccttcagcgtaaggggggctgggtcagccgggacaccgttgacgcgtttgaacattacgccaaaacatgcttttcgctattcggtgacaaagtgaaaaaatggttcactcacaacgagccgattgtgccgattgaaggcggctacttatacgactttcactatccgaatcacgttaattttcaagaagcggtgcaggccggcttccataccctgctgtcgaatgcaagggctgtcaaagcctacagagaattgaaacaggacggacaaatcggaatcattctgaatctgacgccttcttatccgagaagctcacaccctgaagatctgaaagcatcccggattgccgacgcctttttcaaccgctcatttttagatcccgccgtaaagggcgaatttcctgaggagcttgtcgagattctcaaggcggaaggctttctgccgcgttacgagaaagaagatctccgcctcattcaggagcatacggttgacctcttaggcgtgaactactaccagccgagacgcgtcaaggcaaaagaacatgttccgaatccgcacgcccctttcctgcctgagcgtttcttcgatccgtatgttatgcccggacggaaaatgaacccacaccgcgggtgggaaatatacgaaaaaggaatctatgacattctcaccaatctcagagaacattacggaaatatcgaatgttttatttccgagaacggcatgggagttgaaggcgaggaacgcttccgcgatgaaaacggcatcattcaggatgattacaggattgaatttatccgggaacatctcaaatgggtgcatcgggccatcggagaaggttcaaatgtaaaaggctatcacctgtggacttttatggacaactggtcttggacaaatgcttataaaaaccgctacggctttgtatctgtcaatctggaaaacgggggcgaacggaccgtcaaaaaaagcggccgctggttcaaagccgtttccgatcaaaacggattttaacagatgaggaggtacagccatgcttggaggtattgaagccggcggcacgaaatttgtctgtgccgccggacaaaaagacggcaccattctggacagggcggagtttccgacgggagaaccggatgacacactcagacaagtcatccgttactttaaagatttcccgatagaagccatcggcatcgggtcgttcggaccgattgacatccgccccgacagtcaaacatacgggtgcatcaccgcgacgccgaagacagcctggcggaactgccctattcttcaaacgatcaaaagcgcactgcatattcccgcaggcttcaccaccgacgttaatgcggcggcgctcggagaagcttctttcggcgcggccaaaaacgcggacagctgcctctatttgacggtcggcactggcatcggagcgggcgccatcatgaacggcagatttgttcaagggctgtctcatcctgaaatgggccacatttatgtcagaagacacccggacgacggctacaaaggcaattgcccttaccatacagattgcctggaaggcctcgcggcaggtcccgccattgagaaacgctgggggaaaaaagcatatctgctggcggatcagcaggaagtgtgggagcttgaaggctattatattgccgaagcgcttgtgcagtatattctcatactttcgccggaaaagatcattctcggcgggggcgtcatgaagcagcatcagctgttctcttatatccgtcagcacgtgaaaaagcggctgaatcaatatattgatctgcccgacattgaacacttcatcggtccccctcaattagggattcactccggcgcggccggttcgctcgtattggcggagcgcgcattagagacggcaaaccgggaggcgggaaaatgacgaaactcttatttttggaaccggtttttaaagaaagattatggggcgggacgaagctgcgcgatacattcgggtatgagattccttctgagcggacgggagagtgctgggcgatttcagctcatccgcacggtacatccatcgtgcggaacgggccattttccggaacatcattacaccgtctctggaatgaacaccctgacctgttcggacatccgaaagaagaagcttttcccctgctcacaaaaattcttgacgcaaatatggacttatccgtgcaggttcatccggatgacgcatatgcacatcggcatgaaaacggagaactcggaaaaacggaatgctggtacgtgttggactgcaaaaaagacgcggagctcattttagggcaccgcgcccaaacaaaagaagatttcgttcggctcattgaacgaaacgagtgggatcacctgctccgccgcatccccattaagcccggcgactttttctatgtcccgagcggcacactgcacgctttatgtgaaggtacgctcgtccttgaaatccagcaaagctctgatgccacctaccggctttacgactatgaccggacggatgggaacgggaataaacgcgagcttcatcttgagaaagcaattgacgtaacagacattccccataccgatgaaaatgtaaaaagcactaagcatcggatcggagatgctcttattacgatactcgccgaaacacctttcttttcagtttatcaatgggatgtgagcgggaaagcatcattccccgcacccggccggtatttactcgcaagcgtcattaaagggcgcggagaactggatggatgccccgttcagaaaggcgatcactttatcgtgccggcggattccggagattttgttatagaaggagattgtgaggttatcgtttcacatccttcatcatcttaaaaatcaggaggtcttttatatgcttaaaaagttagcagtctgcctgtctatcgttttattactcttaggagccgccagtccgatatcggctcacaccgtttatcccgtcaacccaaatgcccagcagacgacaaaagatatcatgaactggctggcccacctgcccaaccgttcagaaaacagggtcatgtccggagcgttcggcgggtacagtgatgtcactttttcaatgacagaggaaaaccgcttgaaaaacgcgacgggacagtctcccgccatctacggctgtgactatgggagagggtggctggaaacagcggatatcaccgatactatcgattacagctgcaacagcagcttaatctcatactggaaaagcggcggcctccctcaggtcagcctgcatctcgcaaatccggcctttccatccggaaactataaaacggccatctcaaacagccagtacaaaaacatccttgacccttcaactgtggaaggaaaacggcttgaggcgctgctcagcaaaattgccgacggccttactcagctgaaaaatcaaggcgtcaccgttctgttcagaccgctgcatgaaatgaacggcgagtggttctggtgggggctgacaggctacaaccaaaaagacaatgagagaatctcgctgtacaaagagctttacaagaagatataccgctatatgacagagacaagaggattggataaccttttgtgggtgtattcgccggatgccaacagagactttaaaacagacttctacccaggctcatcttatgtggatattaccggtctggacgcttacttcactgatccgtatgcgatatcaggctatgatgaaatgctgtctctgaaaaaaccgtttgcctttgccgaaaccggtccgtccggcaatatcggaagctttgattatgctgcttttattaatgcgatcaggcaaaaataccctcagaccgcgtactttttgacatgggatgaacaattaagtccggcggccaatcaaggcgcgcaaagcctttatcaaaacagctggacgctgaacaagggcgaaatatggaacggcgggtccttgacgccgatcgcggaataaccgcttcttttgaaaatcggttttaaaaaacggctctgctgggcatattgttaccgttcaaaaaggagggttcaacaatggaaaataacaaaaacagcgaagaaacgctttccagtaagacgaccggtaaaggcgagtcagaagacacgctgacaaaccggcagggccatccggtcactgacaaccagaatgtcaggacagtcggcaatagaggaccgacgacattggagaattatgattttttggagaaaatcagccactttgaccgcgaacggattcccgagcgcgtcgttcacgcgcgcggcgccggcgcacacggatactttgaggcgtacggaagttttggagacgaggagatttctaaatatacaagagcgaaagtgtttcaaaagaaaggaacgaaaactccggcgtttgtgcggttctctaccgtcaaccacgggaagcattccccggaaacattgcgtgatccccggggttttgccgttaagctttataccgaagacggcaactgggatctggtcggcaacaacctgaaaatcttttttatccgtgatccgctgaagttcccggatcttgtgcacgcatttcagcctgatcccgttacgaacattcaggacggcgagcgtattttcgacttcatttcccaatcaccggaagcgactcatatgatcactttcttgttttcgccgtggggcatcccggccaactaccggcagatgcagggctcaggcgtccatgcctacaaatgggtcaatgaagaaggaaaagccgtgctcgtcaaatatcactttgaaccgaaacagggcatacgcaacctgacacagaaggaagcggaagagattcaggggaaaaactttaaccatgcgacacaggatttgtatgaggcgattgaaaaaggcgattaccctgaatgggaagtgtatgcgcaaatcatgactgatgacgagcatcccgagctggattttgatccgcttgatccgaccaagctgtggtataaagacgatttcccttggaagccgatcggcaaattggttctgaacaaaaacccggaaaactaccatgccgaggtggaacaagcatcattcggaacgggcgtgcttgtggacggccttgatttttcagatgacaaattacttcagggacggacattcgcctattcagatacccagcggtaccgcgtcggcgcaaattacctgcagctcccgatcaactcgccgaaaaagcatgtcgccaccaaccaggaaggcgggcaaatgcagtatcgggtcgatcgggcagaaggacaaaacccgcacgtcaactatgagccgtccattatgggaggactcaccgaagcaaagcaggatgggaaagaccatacacctcatgtcgaaggcgatgtgaagcgggaagcgatcgaccggccgaataacttcggccaggccggtgaaacataccgcagattttcggaatttgaacggaccgaattgatcacaaacctggtcaatacgctttcttcctgccggaaagacattcaggatcaaatgattgagaatttcacaaaagcagatccggactacggaaaacgtgttgcggaagggctgaaaaaagcctccgaaagcagcagcggcgggccgatcggcactactgatacagcacaagccgcaaaacaggctgaacaggaaagccatccgtctgatccgtattaaataaaaaaacaggacaatcgcgtcctgttttttttttgagctaattcagctcctgtatattctgctccgccgcggccgcaaatactttcggctccggacggtcaagatcttcatggaataaacttactttgtgaatctgccggttgtcgtacagatgaaagtagtagttcccggtgtcacagcacatgaccgacgtatattgcgtataatcaatttcattctcctctgtgatcaccgcgccttttggaatattcacattggacagcacgtgaaaagcggccgtaacgccatccgtttcatgagcggcaggctctaaatgctctttcagataagcggctctgatgaaccgggatggcggcgtgtaatcaccgggaagcccgatcgttccagatccttggccgaaagcggttaatgtcattccgcccaatgttttgctttctgactgctgcggcctgattccgatataatggcgcagattggtcacatgccaaggaaattccggactgttggtcatcactccgggtttgttgtcatatactttcattccctccggtgtcggctcgatgacaatgcagccgcccgtgcggtctgataaaatccaatgaagaggcagcaccgtatccaataacattaacttcttctctacaatcgtcagcattgagagcttttcctttatgtcttcaagagattcacagtttgataaggcccaggtgacaaactcatgaggagcgatgtgacaggtgccctcccgttccgctttctcgtatcccgcaaagcccggaaaatacagcgtcgcacacgacagccctttttcatttacgccgtcggcaaacagaacattgccgagatttctccccatgccgataaatgcgtatttcgtcttatgcatcctgccgtcagcttcgcttttccagctgtactgacgagggtaaagcacgacgtccgtaccgagctgaaatgcaaaatccatcgttcgcgccaataggtgattgccgtctgtcgttttcaatgtaagacttgtacacatatcatcaatccccttttcattaatgaaatttacacaaagtaaactattctttcagcttaacgaataatggctccattcgtcaaaagattgacacatttctccttcatacatattagtcagtaagcatatccataccttttaatccctggtaaatcgtttaggcggcagtgtttgttccgtttttcaaaaaactttgaacggctgtcagcgaggctttacaatgtttttcctgcatgctggaatttgtaaacggcaggtcaatctgttaagctatgtctttatgttaaagaagaacatacggaggagattatctattgaaagtagaaaggcgaacgattgaacatattccgcatgacgaaagacacggaaaggctaaagatttattccccgtctggttcggggctaatatgcatattacgacgttagtcacaggcacactgcccgttacaatgggactcgatctcttttggagtatcgccgccattgtgatcggaacctttatcggcgcaatctttatggcgtctcattccgcacaaggacctcagctcggaattccgcaaatgattcaaagccgcgcgcaattcggcgtgatcggagcgattctgcccctctttttggtcatgtttatctacctgggcttctttgcgagcagtacgattctcgcagccggtacactgagcagctttgtcccgattccggcttcatggtgtattatcggcttaagcgccatctgttttttactcacgatctacggtcatgatctgattcacaaaatgcagaaaatcctctcttggacctcctttgccgttttttttgctgcaacgattcttatttttcaactgccgattccttcaggaagctgggtgcccggctcattagatctgcctgtttttctagtggcggtcagcgcggtggccacatggcagctggcatacgcgccatatgtcgcagattattcccgttatctgccggtcaaaacaccggcatcgcatactttttggtacagctatgcaggtacgtcagtcagttccatctggatgatgcttctcggcgccattttgacgacggcgctcccggaatttaccgctaatgcgggaaatgagattgtccgattgttcggtccgttttcctttattatgctgatcatcgtcctgttcgggcaaatggcgatcaacgtctttaatttatacggagcctttatgtcaaccacgactaccttggagccgtttttaaaactgaaggtgacgccgaaaacgagagtggtaatgatcctttgtgtgacggcagcgggtactgtattaagtctcttgggccaaagcaatttcatggaactgtttttaaatttcatctttttcatcagttatttcttaattccatggacggcgatcaacctcgtggattactattttatccgccgcggaaaataccacgtcaaatcgatgtttgacgtcaacggacaatacggcagggtcaattggattacagcggccgccttcgttttgtcgattatattagaaatcccgttcatcaatacatccttttacatcgggccgctcgctgaaatattcggcggaggcgacattgcctgggtcatcggcctggccgttccgtcgctgctgtattatgtcctgatgaaatcaaggttaaaacaaaaagaggcgccttccctatgaagacgccttttctttattcatattccttccatacacccggcagcagttcagaaagttcgtgcgccaataaggtatgggcggagcgctctttcgtccataattccgcacattcgccgtgaaggcggacggcgttcaatacggcgtgcttcgggtcttgatgacagcacagcatgccgagaatcattcccgacagcgtgtcgccggtcccgccttttgcaagcgcgccgtttccggttgtattcctgcggcattccccgtcgggaaaagcgataatggtttcgtttcctttcaggacaatcgtgacatgaagccgctccgcccattccgcggcatattccgctctgttctgctgaatctcttgaatcggaaggcctgtcattctggaaaattcgccgggatgaggcgtcaagatcacgggagctttcctcttcggataggttcttttcgtaatggcgcccgcatccagtatgacgggataatcgccagaaagcagctgatcagccgcctgctgcacctcgtctgtttggggaaggcccggcccgatggcagcggcccggatggtttccccgggctggcccgccgcggcttttatccacccgtcccgccagtacgtggcttccggcagcaccgggacgataagcggaatgacgcctgccgatgtaccgatgacgagcttgccgacaccgcttctcatcgcacccaatccggctagaagggcggctcccggcatgtcatcgctcccggccagcaataacgccgtcccgaacgtgcctttatggctgtccgcctcccgtttcggcagcgtatctttcacatcctgttccgtccaatccattatattcatctctgtacctcctcttctgtctcctatttatattccaaacaagaagagattttaaaccgcacaaaaaaacagccgctcgtttgcggctgtttatgttctgatcggaacatcaagacggtaaagcttccggtaccgttcgttttctgcaagcagctcttgatgggttccttccatttctgcttttccattttctaaaaagacgattttatcagctgtttccacacccgctaaatggtgtgtaatccagaggatcgttttctctttaaagacatcaaaaatcgtatcaagcaattctcgttcagtgaccgcatcaaggccgatcgtcggttcatcaaggataatgaccggcgtgtcttggagcagaatacgggcaagcgcgatccgctgccgttccccgcctgagaaacgaatccccgtctcctgcacggacgtttcatatccgtcaggcagtgattcaatataatcatgcagcttcacttgccgagccgcacgcttaacatcttcatcactcgccttgccgtttccgagccggatattgttcataatgctcgtgttaaagagatgaggtttctgattcaaaacggccaccgctgaggaaatctgctcctgcacggccgcagtttccagcccgttcagcatcaccttgcccgaatcgggaactaaggcgccttcaattaaagcgagagaggtcgacttaccggagccgctcctgccgagcagcgccattttttccccctggcggagagtgaaggaaaaacggtcaagcacatgactgtgctgatcataagaaaacgtcacgttatcaaatgtaagtgtcacatcggatacatccagtatctcatctgtctgcttcacctcacgacttcgcagctccggagccgccttactcattcttttgatggaatcctgataagaaggcacttccgtcagcgcatccgaaaggggcagaaacgcctccgtcaatggaaatacgacaagcacaaaggctgcgatcatcgtgttggcgatgctgccgtccgcatactgacccgccgtccagaacagcatgatcaatatgaagccgccgacaaggcattgcgcggcgagatcacgccatctcgtaaaccgctgacgtttgctttcaaggtcaaaccatgccttctctttctcttcataagaggaaataaaggccgcctgtcgtcccgagaacatccagtcgctcacgccgagcacggcatctgtcagccggctgtagagcgtattccggccgcttttcagcctcatgtttttcgctctcgtcacaagaagcgacacaaccggaaacaatacaaccaatataaacaggtaaatcgccgcaaaagcggcaaacggccaggaaaaaaagccgagtccgataacggatgccgcatacagcagcaaagcggaaaccgccgggaaaatcgtttttaaaaacgcatcctgcaaatgctcaatatcctcagccaaaatgccgagcatgtcgcccgtccgaaaacgggatgaaagcatgagcgaggccggctccagcatattgtaaagccgcaccctcatatcggacacgattttcaaaatgatatggtgccccgtcaggcgctcggcgtaccgtgagactgaacgggcaatcccgaaggtgcgcacggccacaatcggaacgtacaccagcaggatattctcaggccttgtcgccgacttagagatcaaaaaaccggaagtgaacatgagaaaggccgccgaaaaaatcgtcaccgcgcctaaaaaaatcacaagaacaaacaaacgggcattttgctttatatacggcagaatccattcttcttttctcatgttctttcccccagttgcgcctttacaagtttggcatatacgccttgtttcgccatcaattcgtcgtgggtgccgatttccgccaccgcgccgtcatcaagcacgataatttcgtccatctcaagcatccagtgaagacggtgagtggccagaaagacaagtttgttttcaaacaggtctttcatcgtttcttttatttcatattctgtttcaatatcaaggtgagcggtcggctcatccaaaaggagaatcggccggtttcctaaaaaggctctggccagcgcgacacgctgagcctgccctccgctgagcgcccgtccgccctcgccgatccggccgtcaaggccgccgggcagatcgcggatcagtccggaaagacccgctgaatcagcagcgcgcgccgtttcctcacgggaagcatcaggatgataaaaccggatattattcataagcgtgtcatcaaaaatgtacggatgctgcgggatataaagcagctgcttctgccagccgtctgactgcagatgcgagcgggattcaccgtttaccttgatctcaccggacgcaggctctaaaaagccgcccagcacatcaatgagtgtcgattttcccgcaccgctttccccgataattccgattttcttcttccctttaaaggacagatgaaattcagacatcgattctcggacggacaaacgcgtaagctgtaattcatccccgtcagtccacgtatcaagttcgagcggcttttcttctttaaaaccgggctgcgccaaaatcgcttgaatggttttccccgcctcctgcccgtttaacgtcgcgtggtaatcatttcccacttcgcggaccgggagaaaatattcaggcgcgagaatcagcgctgtcaatgccggaccgagcagaatttgtccgtctatcagccgcaggccgagaaacacagccactgtcgccaccgacagcatcgtaaagaaatccagggcgaatgatgataaaaacgcgacccggagcgtgctcatcgtcgccttgcggtatctctcactgacatgaaagatgtttttactgtgtgatttgcttaaccctaaaaaccgcaatgtctccagtccgcggagcgaatccacgaaatgattggaaagcgtctgataggacttccattggcgatcggcttttttctgtgcgacaagtccgagcaggatcataaatacaatcaaaatcggaagcgcaagaatcagaatcaaagccgatgttttatcctgaaaaaacacgtaaataacaacggccgccggcacaatcgccatgctgaccattttcggcagaaacagctctaaataacggcggaactggctgatgccttccatcgccagcgtcaccatccggcccgtcccctcttttttcgcaaagcgggggccgagacggaacaattgctcaagaaatctttttcttaagtctgcgccggtttgcgcggcatattggtacacgattttctgccggaccgcggttaccgcatgccggaccaaaaacgcaagcaggaaaaagccgataaccggataaagagaagcaatccgcttcccgttaaataatccggttaccgcctggctcagccattccgcctgcaagatgatggcggccgtttgtataatcgttaatcccgtaatgatcgcaagaatccgcttcattcctttataaagaaacaggtcttttcccattaataagtcataggctccttatggctgacgcgtttccggaagacataatagctccagatctgactgccgatgacaaacggcagcagagtcagtgcaacaattgtcatgaccttaagtgaataatcaccggaagacgcgttagctactgttaagtcatacgcgcttttcagcgagctgaccatgacgcgagggaacagagagataaaaatcatcgcaactgtcaaagcaagacccgcgccggtcataccgaatgcccagccgtcttttttcttgctcatgaacacaacagcaagaacgttgcagatgacaatcagcacgaataccggaatcgtgatgtttgcccggcgtgtaaacatatccgtatcgtatgcagacatcgcaaagaaagcaagtacaacaagaaagataacaccgattacgcgttttgccatttttctcgcacgctcttgtaaatcaccgatcgtgcgcagtgtgacaaacattaaaccgtgcaggaatgaaagaagggtgacggctgctccgccaaggacggaatacacgttcacaatatctgagaaacccgcatgcatattcatatggccgtcaatcggcatgccgcggaacaagcttgtgaagataaggccgaatacaaacggcgggataaggctgccgaagaaaatcacccagtcccatgttttgacccattttaaatgattcacttttccgcggaattcaaacgccaccccgcggcccattaaagcaagaaggatgatgataaacggaatataatatccgctcagcatcgtcgcataccagttcgggaatgccgcgaagatcgctcccgtacctgtcagcagccatacctcattcgcatcccagaacgggccgatggtgttaatcagcactctgcgttctaattcattatggccaagaaatcgggtcgaaatgccgacaccgaaatcaaaaccttctaaaaagaaaaatccgacaaacaaaactgaaacgagtacaaaccaaagatcatgaagtgaccccatggtagacctcctgactgaacggatccgttgatacaggaacatccttgtgatcatcatggtccgcaccttttttaatttcacgaacgaataggaagacaagcagcgcgcctaaaatcaagtacatgacgccgaaaccgataattgaaaacagcagagatcccgtcgttacgttaggcgaaacggattgtgcggttgtcatttgccccataaccgtccacggctggcggccgatttcagtcataatccatccggcagagttcgcaatgaacgggaatgcgatcagtgcgatcatgccccgtaaataccacttgctcgtatgaagctttttgcggcggttcagaataaagcctgcaatcgcggcaaaaatcataagcgcacccgctcccgccataatgcggaaactccagaacgtcgttttaacaggcgggatatagtcgccttttccgtacgttttttcatattctttttgaagtgttttcatccctttcacactgccgctgaacttctggtaagccaagtagctcagtgcgtaaggaattgaaatttctgatgtgtttttttctttattcgtatcaatattcgcaaaagccgtccacgcggcaggatcaccgctgtcatcccaaagcgcttcactggcggccattttcatcggctgcgattccattaaatgctcagcctgcatgtgtccgctgaacgcaacgccgataccggcgatcagaccgacaatcatcgaaagcttgaaagatttatggaagaaaggcacttcttttttcttcaataatttaaatgcgctgacaccggcgataaagaaagcacccgtcgcaagcgctccgaaaatgacgtgagggaattcaacccaaagctgagggtttgtcaaaagcgctccgaagtcattcatttccgcgcggccgtttttaatcgtaaagccgaccggctcctgcatgaatgagtttgccgtcaaaatccagaaagatgacataatcgttccgaaggatacaagccaaatgcaaagcaaatgcacttttttagataaacggtcccagccgaaaatccataatccgataaaaatagactccataaaaaacgccaaaagcgcttcaatcgcaagcggagccccaaatacgtccccgacaaaacgggaataatcagaccagttcaatccgaactggaattcctgaagaatccctgtgacgacgccgacagcaaagttaattaaaaagagatgcccccaaaatttagccattttgagataggtctcttgttttttgacaacataaagcgtctccatcaaagcaaccataaacacaagcccgatagacataggcacaaacaagaagtgaaacaatgttgtagatgcaaattgaatgcgggctaataccaactcactcatgatgtttttcctccaatctggtaaattgctcaacatttcacaaacatagtgaaatcattgctcggtatttcacaaaaaatgatatatttgctcaatgtttcacaaattcgtcaaaactattgaaatatcagcctgtacaccctgggggacagcggctgtcatagaaatgattcaatatcattactttacaacgattcagcccaaaaaaaaagatcaatatacctaaaatcaggctgaaattgtgactgattattgtcggatttgtagagattttatgtcagcacctaggatatttgtccctttgatatcgtacctcttttttattcgtgtggcgaacaaaatgcttttctcggtgaaaaagcccgccaaatcgccattttgagaaagaaaatgtgaagaaagcatgtcctctagtaaattcataatatatgaacaatttaaattttttagtatactttaaatggggatattttttcactacataacgactgggggaacaagcatgggagaacttcaaccaaaattgcaaacggattcaatccaaaaacaggaacggactgataactggtttgccagagcaatgaatataagaatcggcattattcctcttcctatctatatcctgcttttcttgcttattacggtgtttgtcatgagccgtgatgtaaaaagcgacattctgacatcaattgccgtcatgagttttttcggatttaccttcggccagatcggaaaatccattccgatcgtgcggtccatcggcggccctgcgattctcgcaacctttattccatccgctgtcgtctactaccacctgcttccgaaagacattattacttcaacaacagaattcacggaaagctccaactttctctatctatttattgccggtatcgtcgtcggcagtattctcgggatgaaaagagagacgctcgtcaaagctttcgttaagatttttattccgctgatcgccgggtctatcgcggccgccatcgtcggcttatgcgtcgggacgctgctcgggctcggctttcagcacacgctgctttatatcgtcgttccgattatggcggggggtgtcggtgaaggcgcgattcctttatccatcggctactccgatattatgccgatgtcccagggagacgcctttgcgcttgtgctgccgtccatcatgctcggcagcctgtgcgccattatgttatcgggtttgctgaatgtcatcgggaaacgcaaaccggaatggacgggcaacgggaaggttgataagtctgatcattccgctcccgcattggaacagccggccgatgataaaacgtttgatttgtcctttttcgcttcgggcggtattttagcggtttccctttatttggtcggcatgctggcgcatgatttctttcagcttccggctccagtcgtgatgctcgtccttgccgttctcattaagctgttcaggctggcgccggcttcgattgaaaacggagccttcggcgtctcgcgctttttctcgacagccgtgacctatccgctcttatttgcgatcggcgtttcaatgacaccgtgggacaagctgattgcggcgtttacaatcagcaacatcattaccattttatcaatcgtcgtcacgatgatggccgtcggttttctgaccggaaaatggctgaatctgtacccgattgaaacggcggttattaatgcctgccattccggccagggcggcaccggcgacgtcgcgatcttgagcgccgctgaacggcttgagcttatgccgttcgcccaagtgtcgaccagaatcggcggagcgattaccgtgagcgtcacccttctgctgcttcatcaattctattaaactgaaaaaaagcctccgcatatgcggaggctctgttatttcatcacattttgaatataagagccgaatgccgcgccggacatgcccggcgacacacggacgcggtgaagcccgtaaagcccctgatctctagacgccgctcccggctccgtcgtgaccgccatacggtagcctgacgaggcggcggcttttaatgtttctttattatatcgtccgacagggtagctgatcatagacgtccgctgcccgaacatttgatcaaataaacgcttagagtccttcatttcacgtcgctgctgctgcggtgtgagcccgttcaattcgagatggttcatcgtatggctctgaatggaaatgccgtgggcggccatctccttcatctgcttctcagtcagatgattcttatgcccgataaagtttccgatcataaagattgtcgctttcatcttgtatttctttaaaatgggataggccgctttcacattgtctgtatagccgtcatcaaatgtgaccagaacacatttttcacgcggctccttatcctccgtcagcatcagataggcctcttcaggagtcatcgtataatagccgtgatcatgaagccacttcatatgctgccggaattcttccttcggcacacgcaggctgtttccctctgaaatgctgtgatacatcagaatcggcagtctcgccatccctttcgtttgaacccaggcggacgtatccggctcttttttgatttgccgctttacggactttttttcgctgtgcgcttctgccttcggaatgctttgttcggcgcttgcctcatgacccgagcaggcggcaagtgtaaacacggcagccaaaaggcacatgcacatgatcatgcgtttcatcgttttcctgctttctgtcttctatttactttttatatcggttatgcgtcataaattgttacatcaaaaaaaccggacatccagctgtccggctttgcgttatgagcggattctgatttctgtttcactgtcaaaaaagtgagccttattcatgtcgaaagcgacggtcaattcctcaccggcacgaatgtcatggcgggcgtcaatccgggcgataaaatcctgatccccgatccgggaataaaccataatttctgacccaagcaattccgcgacattgattttagctgtgatggatgaattcttataagattctaccacaatcagctcgtcatgtatgtcttccgggcggatgccgaagatgatatctttgccggcataccctttttcccggagcattttcattttcccttccggcacgctgagagcggctgaaccgatctgaatggcgccgtccgtcagctttcctttgaaaaagttcatcgccggagaaccgatgaacccgccgacaaatacgttttcgggatgttcatacacttctttcggggtgccgatctgctgaatttttccgtccttcatgactacgatgcgtgtcgccatcgtcagtgcttctgtttggtcgtgcgtcacatagattgtggttgtttgcagcctttggtggagcttaataatttctgcccgcatctgcacccgaagctttgcgtccagatttgacagcggctcatccattaagaacactttggcgtccctgacaatcgcccgccctaatgcaacccgctgacgctgtccgccggagagcgccttcggtttgcggtgcagatactctgtgagccccagcattttcgccgcttcttcgacacgttttttaatctccggtttcggcatcttcctcagcttcagaccgaatgcgatattatcatagaccgtcatgtgcggatataacgcatagttttgaaacaccatggcgatatccctgtctttaggagcgatgtcattcactctcgtgtcaccgatatagaaatcgcccttcgtaatgtcttccagcccggctaccatccgcaaagttgtcgacttgccgcaacctgacggaccgacaaacacgataaactctttatctttaatatgaaggttaaaatcatcgacagccgcttctttttgatcgtaatacttataaatatgctcgagccgaagttccgccatgtatatccccctttatttgtaaacgctttcttaaataggattgtaacagcgtcagacggcggcggatataggcaatgttcataaaaaaagaccgctgtcttcgtgcacatttcccatttaatgtgatttttcatattgcagacaaatgaaataagccagcagggcgccccgatatgtcttaatatcaatacctgagcgttccgcaaatttatcaatccgatattgaagactgttgcggtgcaaatgcagttttttcgatgtgagcgacatgtttgagttatgttcaataaaagtctgaatcgtatgcttcagctccggttctttctgaaacagcagcgccgcttcttcgtgaagcaaggctgagagcttttctctgctttcctccgtgagcatggccggaaataccgtttccgcggtcagcgtgctcagctgcgggagatgacgccggccgatctgacaatattgctgttctctctgataatgaaggcgcagacgttcccccttgcagtaataccttccgacgaaaaaacggacactgaaataaaaatcgccttcgagaatcttcacaaaagatgcgatgtcatccgaatctggcgcttccagcttttcttcctccacaatcacgccatgatccctccccgtccggacaactgtatatgaaaccggccagaaatggcgcagcgcttctgtgaatgccccccagtcccgttctcccaataagtcataatggataaaacggacacgcggctccttgacatcaggcaccggaccttcttccagcagaaaacgccgccacctctttgctgccgccgtctccggaaaaaaaacgcctttttcttcagcgggcgtcaaaaatgattccagaagcagtttctccttcggggtgatatcctccttcggaatggcgacatagacccgccttttctcatcataaaagcaaaagacatcctccgccgtacagcacgtatcagacaacacagccctcgggtaaattgccaataacgggttcatatgcgctcctttctatcgctctatcatattttcagtataaaacgtccggccgattgtatccacttcgttttaagaaacagctttcaggctatttcccgggaaacggatataaccgcttctgccggcataagaaaaaaaccctccgcgccggcagagggatcctttttatttagagatatcgacgaagccttcaccaaagacatcacgcacatcatgaacaatgacaaacgcttttgtatcacagcttttaataatttttttgagcatggaaagctcttgtttctggatgacgatatataaaatttccttcgactgccccgtgtaatttcctttacccgacagcagcgtaacccctctgtccatcagcgtgttgacctgttcagcgatttcgtgcttatgctcagatataattgtcaccgcttttttcgtattcaggccttcaatgataaagtccatcaccttcgttccgatgtacagcataacaatggtaaacatcattttttccgcaccgatgatgaaataagaactgaagacgacaatcagatcaaagaacaaaagcgcatagctgatattccaatcgagatatttgttcgcaatcctcgccaaaatggcagaacccgcagtcgtgccaccgactcgaataatgatcccgattccgacaccggcaaacacacccgcaaaaatagtattaataatgagttcatgtgaaggcgagtgccaatcatgcgtcagatgcagaaacagtgagttggcgacaacggtaatgatcgtataaagcgttgtttttccgtctaaaaatttatatccgataatcaataaaatcccgttcaaaatgatattcgtcaccccgggcgaccattcaaacacatagtacaagatcagggtgattcccgttaccccgccctctccaagatcattcggaatggcgaataaattaacggccaaagcaaagataaaagctccaataatcagcatcagcacatccagcaatctctttttcatcccagacactcccttttttataaaatcaaaaaagcccgggagagcactcttcattaaaagagcagaaactcccgggcttttatcccaacgtgtcacagcaggaacctgctgtgtgttttctctcggtccagaccaattcagcattgcggaaccctagaaaaccactgttttttatgttcagtttttatattatctttcaagattatacgggaaatcacgaacatgttcaaccactcttttttcattaaacctatggaaaatgcgaacgatctgccgatactaaaaaggaccttaaaatacatgactaaaaaatcattaaaatactttttttctcaaaatattattgactataggttattttacaggcattatagtatgtagtttttaagaaatagtttacataggaggaaatattatggcaggcaacctggtgtcttgtaaggcatgcggcaaagaaatcgctaaaggcgttaaaaaatgcccaaactgcggtaaagatcagagaaactttttcatgagacataaaatcatcacattgcttctggcagtggtggttattatcattctcgtaaacatcggcggcggaggcggttcttcgtcatctaaaactgcgtcttcaaaagctgcggaatctaaagaaaaactgtataacatcggtgacactgttaagactgagaaaactgaagttactgttacgaaagtggaaaaaagagattcagtaggctctcaatttgtcgagaaaaaagcgtctgacggcggcgttatcgtagctgttcaatacacggttaaaaatgtttcaaacaagccgttaagctctttctccattccaagagcgaaattagtagattctaaaggaacatcttatgattcagatattgatgcttcttcaagctatgcaacagaaacaaaagtagacaacagtaaaattttaagtgacttgaacccgaacattaaagtgactgacgtaaaagcttttgaagtggataaaaacgcatactctaaaggcacttggaaattaaagttcagcaacgatgttgaagtgaaaattaaataatcatcataacaaaagagaccctcatcatttgaaggtctctttctttttacaccttttggtacccgttcacattggaggactgccacttccaagagtcggcgcacatttcttcaagcccgcgctttgcttcccagcctaattcagccttcgcttttgccgggtctgcgaagcatgcggcgatgtctcccgggcgccggtcggcaaaacggtacggcacttcttttcctgatactttttcaaacgccttgaccatctccagaacgctgtagcctcttcctgtgccgagattataggcgtcggcgcccgttgtgttcagcaccttttcgagcgctttgacatggccctcggcaaggtcaacgacatggatgtaatcccgcacgccggtgccgtcctttgtcggataatcattgccgaacacctgcaatcgctcaagcttgcccacagcgacttgtgcgacgtacggcattaaattattcgggatgccgttcgggtcttctccgatccggccgctcgggtgcgcgccgaacggattaaagtagcggagcagcgcaatgctccattcagagtccgcattatgcagatcgcgtaaaatctgttccagcatcagctttgtctgcccgtaaggattggtggcgcttaaaggaaaatcctcagtgatcggcgttgtttccggaacgccgtaaaccgtcgctgaagaactgaagacgatttttttcacaccgtgtgcctgcatggcttcacataaaataaacgttcccgtcagattattatgataataacggagcggaacagccacagactcaccgacggcttttaatcccgcaaaatgaatgacggcttcaatctcattttcagcaaacacccggtgaacggcggcacggtcaaggagatccgcttcataaaacacaagcccttttccggtaatgtctttcacacgctccaatgcttccggtgaactgtttgacagattatccagaaccacgatgtcatagccgccgtttaacagctcgacacatgtgtggcttccgatataacccgctccgcctgtcactaaaatcgccatgaagaaagcctcccctattgaatgaattgaccatattatatcggttttttcttcctcaatcatccatttccaaaaagtttaatcgtttagtcatcgtttcttcataatttattttcattcgcgtaaaaaacagagccctcgattcaaacgggttgtgaaatagaaatccctcccccgcgcatggtaagataagacaaaggagatgacggtatgaaaaatgaaatcattgaacgctttacctcttacgtaaaagtcgatacacagtctgacgaaaacaatgaaaactgcccttcaacccccggccagctgacattggccaacatgctggcagatgaattaaagtcgatcggcatgacagaaattacagtcgatgacaacgggtacgtcatggcgactctgccggcgaatacggataaagacgtgccgactgtcggttttctggctcacgtggataccgcgaccgattttaccggaaaaaatgtgaatcctcagattattgaaagctacgacgggcatgatatcgttctgaatgacaaactcaatgtcgtcctgtcgcctgagcaattcccggaactttcccgctataaaggccagacgctgattacaacagacggcacgacgctgctcggagccgacaacaaagcgggcattgccgaaatcatgacggcaatggcgtacttgatcaaacatccggacatcaagcacggaacgatccgggtcgcgttcacgcctgatgaagaaatcggcagaggccctcacaaattcgatgtcggccgcttcaacgccgcgttcgcctacacgatagacggaggccccctcggcgaactgcaatatgaaagctttaacgcagccgccgcaaagcttacttgttacggaaaaagcgtccacccgggaacggcgaaaaacaaaatggtcaacgcttcaaaaatcgcgatggaatttcatcacgcgctgccgaaagaagaagcgccggaatatacggaagggtatgaaggcttctatcatttactttccatggacggagacgtttctgaagccgccctgtcgtacatcatcagagattttgacagagaccgcttcgcagaacgaaaagaatatatgcagaaaaccgccgatgcgctggcggccaaatacggcaaggaaagcatcaagcttgaactgcgtgatcaatattacaacatgagagaaaaaatcgaaccggtcaaagagatagtcgatgtcgcgtatcaagccatgaaaaacctcgacatcgaaccgattatcgaaccgatccggggcggaaccgacggctcacagctctcttacatgggactgccgacaccgaacattttcacgggcggccaaaacttccacggaaaatatgaatacatttccgtcgatcatatggaaaaggcggtaaacgtcattgttgaaatcgccaggctctttgaagagcgcgcttaaaaccaaagcccctgctttggtttttttctttcacatgaaacctttccttctttctttccgtatataaggtatgaaatggaaagaaggagtgaagactatggcaagagggactgtagcgaaagaattgaaaaaaaccttaaaagacccgcgtgtactggagacaaaatcaaacccttttaaaaaactgcggaaaatgttcaaacgatttttttaagataacatctcgttttctttaaaaaaataaagaaagcgctgtcaactcgcagtcatctgttagaagcagttattttgcatatcataaggttttttagggtactgaataacacaaggcaaacgaaaacaccgaagtagttaattagacacttacaaaaaatagtaataaagttatataaacgatcatcattcatcagccgatacaatctatagaaccacaacaagagcaaaatttcttcaacccatagttatttttacggaaaatgacgttattttttaaaaaagtgacaattgtttgaatacttttcgtttgttttttcgtacaataataataccaaaactttttttgggaggtatgtaaaatgatgctacttattttcgctgctttgacagggtatcttgttttctctttcagtaaggacaaccgccggaaaacgccaaagacaagcccgctggtgacagctgccgacacgaataacatcattgatttaaatgcgatccgtcaaaaacgccggatgccgctatcataaaaacgacagctgccgcaaaatcggcagcctttttttatgcacccggccgatatgaaaccttccgcctccttttttcgtaaaacataaaaaaggagtttttttatgtaccatttttacatcaaagagcgaatgtttacgtttaagaatcgttttcaagtgtttcttgaaagcggaaaagaagtctacaatgttgaaggaaagctgttttcattcggtgatgaactgaagctgactgatttggacggccgcacgctcgccagcgtcaatcagaaactgatgtcgctcgttccccgttacgagatttccgtcagcggcaaacccgtctgccaagtcatcaagaaagtcacgtttttcaaaccgaaatttgaaatttccggactcggctggaatcttaccggcgatgtgtggggccggaattttcaagtgacagacggaaaatcaaaccggatgaccgtcaccaaatcatggatgagctggggcgattcctatcatttgcagattgaaaaggaagaggatattgctctttgtcttgcgatcgccatcgtgatagatatgattctatttgagggtgacaaataaaaatatttatcgaaatatattgacaatatgagaaaacatactaagattaagagtattacagtttattctgaaaaatagcatatttccttatcaagagaggtggagggactggccctatgatacccggcaaccgctgttcagcagaatggtgctaaatcctgaagataaggttgagatttgcggacgcaagctcttccctatccgagggaagagtttttttatatttcatttcatcaggaaagaaggaatcgttcatgtcacagcaaaacacagaacaaccattgcatactcttctaagaaaaaacccgccgtttcgcgcggatcaggtcggaagtctgctgcggccggcggctgtgaagcaagcccgcctgcaaagagcggcgggtgagatttcggcagaacagctgcgcgaaatcgaaaacagagaaatcatccgcagcgtggaaaagcagaaagaaaccggcctcaatgtcgtgactgacggcgaattccgccgtgcctggtggcattttgattttctcgaaaatttagacggggttgaggcatttacgcctgaaagcggcattcagtttcacaacgtacagacgaaagcgcgcggcattaaagtaacgggagatattgatttttctcagcatccgatgctcgaagattataaattcctgcacagcattgccggcgatgctgttccgaaaatgaccatcccaagtccgaatatgctgtttttccgcggaaaattggaaaaagcggcctaccagaatgattacaaacaatttcagcacgatgtgtcaaaagcgtataaaaaagcgattcaggctttctatgacgccgggtgccgctaccttcagcttgatgacaccgcatgggccgttttcttatctgaagcggggcttcgtcagattgaagatttcggcacaacgccggatgagctgcgcaagctgtttgccgcttccattaatgacgcgatcaaggaccgccctgacgatctgaaggttacgatgcatatctgccgcggcaacttccaatccacatggacggctgaaggcggctatgatgcagcggctgaaacgatttttgacgggcttgaccttgacggattgttcctggaatatgatgattcccgctccggcggctttgaaccgctccgctatgtcaaacgctctgatcttcagcttgtgcttggattgattacatcaaaacatggcgaacttgaagacaaggacgcgattaaacgccggattgaagaagcttcacaatatgtcagcctggatcagctttgcctcagcccgcaatgcggattcgcctccactgaggaaggaaacctgatcacagaagaacagcaatgggcgaaactgcgtcatgtcgtcaacattgccggtgaagtctggaaataaaaaaaagacacgcgatcagcgtgtcttttctgtttacagaggaccggttccgattaaaatatcgatatctatcgtaatatccgccgcttttcggctgataaaccgccggatgctttcatcagtacatttccatgttaagggcgtcattttcacaagccgctcaaggtcaggctgcgataaggtcttcgtgtaacacagccgtttgcgctcaaaggtttgaaagcccgcttggaatcgtccggccgcagaatcggcggtgtcattccgccgaggactgtctccgaagaagaattcccttacttccttcaaataatcacgccgcggcaccgctttaatgactgtgccgccctttcgtaaaagcctgctgcattccttgtaattccaaggtgataaaacagacatcacgacatcaaaacagctgtcggcaaacggcgcatccgccacatcagcgacggcaaaaaccaaatgatccccgaaggcctttgcggcatgcagcacaccttctttcgagagatcaatgccgattcccgtcacggaaaaagcgggctgaagcaatttgcatacggcggctaaatgagtgccttctccgcatcccgcatccaatatcgccgccgttgtttgcggagattgaatgcggctgatgatggcggcgatctccttttgaaccggcccaaaaaattcccggctgtcaaaaagagcgcgtctcgcttcgaacagctgcctgtcatagcgggttttgaccgatttattgaggaaattcacatatccttgctttgatatatcaaatgtatgcccgtgtccgcacatcaagcttttgtattgtgagaccgccatggccgaactgcatagcggacacctgaatacggactggcatgattgcagtaattccgcgcgttttctttttatagacgtcaataaaaacacctcattcattcgttattccgatgaaatgaaaaaggcatagacaaataaacctcgcaaaattggaagtttaacctatttatctatacctctcattatctgtaacgaatgaactgaatgatcatgaaaatgaccccttttctgccgtcttttgaaggcggtgccctcagatccattttatcagctgcatcccgtctttacaatgaaccggaactgtttttcgggggctttttatacctttttaatccaattacttgtgaacatcctttattttctttatttataatataaatttattattttgaaaatatctaaaaaggttgattttcaaaaattgaaacgataaaatactgctatctcatgtaatatcgttattcttgtatatgatcagtaatatggtctgattgtttctacctagtgccgtaaaagactagactacaagaaagtttgcataaatttgaacgagtgaaaagcatatgatgctctcagtctattcttttcttttggctcttatttatcacactttctggctttcaggaatttgtgacgaataagagctttttttatttccataatacccttataggagttgctcacatgtactttttattgaacattgtcggtctcattgttgtcatggctgttgttttcttatgttctcccaacaagaagaagattaaatggcgtccgattgtcatgctcctcgtctttgagtttctgattacttggtttatgttagggacaaaagtcggcggctttgtcatcgggaagatcggcgcgttctttacatggctgatttcctgcgccagtcaaggaattgcgttcgcttttccgtctatcatggccaatccgacggttgattttttcttcagcgcattgctgccgattatcttcgtcgtgaccttctttgatatgctgtcgtatttcggtattctgccgtggctcattgataaaatcggctggctgatttctaaaatatcccgtctgccgaagctggagagctttttctccatccagatgatgtttttaggaaatacggaagctttagccgtcatccgccagcagcttgccgccgtcagcaacaatcggcttctgacattcgggctgatgagcatgagcagcatcagcggttcgatcatcggatcgtacttgacgatggttccgtccacttatgtgtttacagctatcccgctgaattgcttaaacgcgcttttaatcgccaatatgctgaatcccgtggacgtttctaaagaggatgatattatttacgttccttcaaaagcggagaaaaaagacttcttctccacgatttctaacagtatgcttgtcggcatgaacatggtcattgttattttagcgatggtaatcggatatgtggcgttaacggctgcgttaaacggcgtactcggactgttcatgcacggtttgaccattcaaaagattttctcatacatcttcagtccgtttgccttccttctcggattaggcgtacatgacgcgatgtatgtcgcacagctgatgggcatcaagctcgcgacgaatgaatttgtggcaatggccgatctgaaagggcagctgaaatcacttccgccgcacacgattgccgtggctacgacattcctgacatcattcgcaaacttcagcaccatcggtatgatctacggatcttatcaatctctgcttgatggtgaaaagtcagccatcatcggaaaaaacgtctggaagctgcttgtcagcggaattgccgtttccttattgagcgcggcgattgtcggattgtttgtctggtaaaataaaaaaagcgataccgctccgttttagagtgatatcgcttttttttattgatagacggatgcaggcacgaaaacgtcccggattcctgccgcgtatggtccgagatcatattgtccaaacacaacggcaatgccgtttttcgtaaagaagaaaggtctttcgttattcaggatgatctcttgttttttgacgtcctggtcaaacagatcgtcatgtttcttgatgtagccgtaaagatagtctctcgttttgttggctttcgtttttgtattgagcacatcattgagtgtgacccgtttttttgcggccaggtcgtaattaaaggtctgaacggctgtcagcccgtgtgcgccgcctgtgtaactgtagttttccgtctgaatgctgagcttgccgccttgattatacttcaccttgaaatctgcctggtattccgctttgtagccttgtttttcaccgtcttttttgttttttacatattcttggtacgagttttcaatatagcgtttgaagtcctgattgattttcttttcaaaagatgcgtttcccgtatttgtgacctcggggtacgtcagctgctttacatgcttatacgtctggcttttgacgacgggctttgcagtttgcgcggcctcggctgaaggcgcgaaacctccgaacggcgcggctgtcagcacggttaagagcacggccgccatcattttgaatgcctttttcatcacaactcctccttttcattaccgttccctttttgaaaacggattacactctatagacagcgcagatcagcaaattgtttctgggccttctttcacattttctccatgaaaaaaagagacatggataatccacgcctcttttaccgtgaaggtctttgcgcaatggcttcataaacggcttccgccaaatcggagttgccgaacatctccaaaacgccgatgacggtttgatcaggaatcggttctgattcctccttcggcacgacaagctcttcagccgtttttcgcagctcttcgtttaaaggctgtccggggtaagctttgctgtaaatggccatcggatcaaggtcatgattgacgcaccattgggcaaacaccaaaatcatcatgttttcgtcacgccggtaatattcttcaagttgtttttcggtaaacggcttcactatcaatcgctcctccagaaaatctacccctaagatacacaaacacagggcggaagtaaaccaaagagggtgaaactattatttcatcaacccgcctgctttaaatagcgcatgccctgactctctaaaactgttgtctgaatgtccaggacagcggaagatacggatttgtacggaagcaattttcgttttctcccaatattctttcacaagaaaaaagcgcccctctcatcaaaggcgctttttcattcttatacgtttctgtcccaatgccgatgctcagccacggctttcagaaattgttcatggtttccgtccggaacaagaccggggccgctttcggttccggcggcgagggcgagaagttcttttccttcaccggaggcgccgatcgctttgtaatggctgaaagcttcgttgacgaagtctctggccgatttttgggctttgaggctgtctgtgctttgttttccgcccggaatgaaaacagcgtcgtacaggacggaatccgctgtcaggaacgtggctgacgcttcgagctccgtgccgttttctcccttaacggttccaagcacaggactgatgatatcggctctgactcccgcctgtttgcatgcgtcaagcacttgtttgactttctcatcagaaaacccgtggtcggttaaaaccgcaacctgccttgtcgctgccgtcttcaccgtgttttcctggcttaaggccggggaagtgaacgtttcatcagattcacggtccttcggcggcgggttcacgccgattcctttcgcaacacgctcggcaagcccggcgtcgacgtgactgaagacatcaaccacctgctgctgcacatccttgctgttcacttttccgacttcaaaacagaacgcggagatgatatgttctttctcggcgggagacatgctgttccagaacatcttggcctgagaaaaatagtcattgaagctctcactgcgctggcggatttttctgccttctactttttcctggtaatgaacgtatccgccttcttcttctgaggccggcgacggatcattgttctgcagggaatttttatgataggcgacagggcccttattaatcgtcatccggtggtagccgtcgtattggttgttatggaacgggcagaccggccgattgatcggaatctcgtgaaaattcggcccgccaagacggatgagctgtgtatctgtataagagaaaagccggccttgaagaagcggatcattggtgaaatcaatgcccggcacgacatttcccgggtgaaaggcgacctgttccgtttccgcaaagacattgtcctgattgcggtcgagggtcatttttccgatcagcttgacgggaaccaactcctccggccacagcttcgtcggatcaaggatatcgaaatcaaatttaaattcatcttcttcgtcaatcatctgaacaccgagctcatactcgactttgccgccgttttcaatcgtttcccataggtcgcggcggttgaaatcgggatctttcccggcaattttctgcgcttcatcccatacgagggaatgaacgccgagcacgggtttccagtggaatttaacaaagcgcgcttttcctttctcgttgacgaaacggaacgtatgcacgccgaagccctccatcatccgatagcttcgagggatgccgcggtcagacatcgtccacatgaccatgtgcgcggattcaggattgtttgcgacaaaatcccagaacgtatcatgagccgtcgcagcctgcggcatttcattgtgcggttccggttttatggcgtgaacgagatccgggaatttgatcgcgtcctgaatgaagaacaccggaatattgtttccgacgaggtcatagttcccttcttcagtataaaacttcgtcgcaaatcccctggcgtcacggacggtgtcagctgaccccttggagcccgccactgttgagaaacggacgaaaacaggtgttttgacggacgggtcctgcaaaaatttcgcccgtgtatattccgtcatcggttcgtacacctgaaaatgcccatgaacgccgtacccgcgtgcatgaacaacccgttccggaatccgctcgtggtcaaagtgcgtcattttttcacgaaaatgaaaatcctccatcagcgtggggccgcggacgcccgcttttaaggaatgctcatcctcagacacgcgaagcccctgattggtcgtcatttttttgccgctgttatcagatcggtactgctccagctgttcgtcctttgagtgttcatttactcgtttgttttgatcatcactcatgtcagttcccccttttaaaacgaaacattctacagcacatttacccgcggcgttctttaaataaactgctgatccgctcattaggattttaggtctgtatttacatatgcggtcatacacattttgaaataagccattttcacagaaacaaaatgtgaaagcgcttaccaaaacagctgttgaacaggggaggtcatatcatgcttgccatactcggttttgtgatgatgattgtttttatgtaccttattatgtctaaccggctttccgcacttattgctttgattgtcgttcctgttgtgtttgccctgatcagcggatttggcaaagatctcggcgggatgatgattcagggtgttacagacctcgctcctaccgggattatgctgttattcgccatcctgtatttcggcattatgatcgactcaggcctgtttgatcctctcattgccaaaatcttatcgtttgtcaaaggagacccgttaaaaatcgccgtaggcacagcggttctgacgatgaccatttcgctggacggagatgggacaacaacgtatatgattacgattgcggcaatgctgcccctttacaaacggctcggcatgaaccgtttggtgctggcggggattgcgatgctcggttcgggcgtcatgaatattattccgtggggcggaccgacggcgagggttttggcttccttgaaattggacacgtcagaagtttttacgccgctgattcccgctatgatcgccggcgttctctgggtgatcgccgttgcttatctccttggaaaaaaagaacggaagcgtctcggcatcatttcgattgaacacgcgccgtcttctgatccggaggcggcgccgctgaagcgtcccgctctccagtggtttaacctgctgctgactgtcgctctgatggccgcgctgatcaccagcctgcttcccatccctgttctttttatgatcgcgttcgccatcgccttgatgattaactatccaaatgtcaaagagcagcagaaacggatttcggcgcatgcgggtaatgcgttaaacgttgtctcaatggtgtttgcggcaggcatatttacaggcattctctcaggcacaaaaatggtcgatgcgatggcgcattctctcgtttccctcatccctgatgccatgggtccgcatctgccgttgatcacggcgattgccagcatgcctttcacctttttcatgtcgaatgacgccttttacttcggtgttcttcccatcatcgccgaagccgcttccgcttacggaatagacgccgctgaaatcggaagagcctccttgctgggacagccggtgcatctgctcagcccgcttgtgccatccacctatctattggtcggaatggcaggcgtcagctttggcgaccatcaaaaattcactattaaatgggccgtgggaacaacgattgtgatgacgattgcggcgcttttgattgggattatttcgttttaattaaaaaaggatttccgctggcggaaatccttttctgtacattatttttttgtatagcgcacccagtcataatgagcgtatagcggatttacaccattgtaggaaccgagccagtcatcgacacctatcccattccacaagttcatcatgatctttcccggtgttgtcgggatttggcttgtcgcagtatgttttaattgcccatcgacataccattttatagagttcggctgccaatcgaacgcatacgtatgataggcattggccgcgtcaaatccgagatccgcaaccttctcatggtttcccgcgccatttgtataataattaaattgaacctttgtcgtgtcttttcctaaaaattcgatatcaatctcatcccaaggggtaccatccgttggacctgtataagtgaagaacgatgaaacgatccccgtgtttttagccggtttcattctgacttcataaagtccatagccataggtttgagcggagcggttctccccgcagtcaaacttgttataagacgggcttgtcagcgccaaacgcatttcacctgatgacgtcacggatacattatttgcacgccaagtgcagttgaacatatctccattggagtaaccatttgctttttgccagaaaccggagttatagctgttaaaaggttcaaaaaacgatccgcctgtttgagctgatgcagcagaagtgatcgcacacaaactcaaaaacaatccagtgacaagaatgagcagcactcgtttcatacgataaaacatgtcggcattcccctttctttgagagcgatttctttatcgatcatacatgattctgttaaaagggaacatcggtcagaataatgataataacgaatcttaaaaaaacctaaattaccatcagcacaaacagaaatgatccgcgctcattgtaatttaggttttgcatgcttatcagcaacaatcctaacaagatcatatgtgaatgtaagaaaaaatgaatccaagaacaataatgccaacgctttcattatgcttgtttgactaccctttctatgtgaatcgttaaatacagcagctcgtcactggtgagcttgtgctcatacgccctctcaatgcaagtttggattttcttcgtgcattcatacgcccgacggtatttttctccagcaaaaagtcgatgtgtgccgttaaaaagacgctgcgcgaaaaactttaagtgggtgacaaaccgataatagtgaagcgattcttcgttgaattcaatcttaaaatggtattttacgatactcaaaatctcttgcatgacttttgtaatgctgatgatattgggcatctcctcattcagctcggcatttacaatatgcagcgcaataaaacctgcttcatcctccggcagagacacgccagtcttgttttttaccatgatcagcgattcttttccgattgcaaattcgtctttgtagagccgcttcgtttcccacagcaaggcgttttgatatccagccctttcttattgcgctgaatggcaaagtaatatggtcggtcagcgacacatagatgctgtcgttgagctttttgccaagctgtaatttcgcatagctgataatctcctcggatactttcatacactcgatcggaatatcatacaaaagggttttgaacttcggatacatctttgttatcgagggtgagcactttctcaatgcgggcttcatctgccggatctcccgttttcttttgaaaagcaatgccccggcccatgatgaccaattcctgattgccttctttgagcacactgacgacattattattattgactttcgcaatcttcaattccgtctccctcccgcctgaccatttacctgctacaccttgattgtacatcctttttgtaccaggtcaatatctccaggtcaatcagaaaacgccgttcagaaatcattgtccaacgatgaggcagaggcgcatataatgcagagaaccggtttttgggaaggagcgtgtgtgatgaaacggttttcgaaagaagaaagcagctggatgctgtatgattgggccaattcagcttattcggtcattattatgacggcggtgttccccttgttttttaaagcggcggcggcggaaaacggcgtcagcgcagctgattccaccgcttatttgggctatacgattgccgccgcgacttttattttggcgatgctcagccccgtcttaggaacgattgccgactacaaaggatgcaagaaacggttttttgccttcttttttctgatcggtgtggcgggcaccgccgcgctggctttgattcccggcgaatcttggatgctgttattaatttgttatacgatttccacgatcggctttgccggatctaatgtgttttatgatgcgtttctcgttgatgtggccgcaaaggagcggatgaatatggtgtccgccagggggtttgggctgggctatatcggcagtacaatcccttttctcctgagcattgccgtgattctgtcagcacaagcggaggtgattccgctgtccgcccagactgcgggccgcattgcctttttaattacggcggcatggtggggactgttttcgattccgctccttctccgcgtccgccagcgctattatatcgagagggagccgcggcttgtgatcagcagttttatacggctggccggcacgctgaagcagatcaggaagcaccgggcgctgtttttgtttctgctcgcctatttcttctatatcgacggggtcggcaccatcattacaatgtccacgtcatacggggctgacctcggcatcagcgcggcaaatctgctgattgttttatttgtcacacaggtcgtcgccgcccctttttcgattttgtacgagcggctggccgaacggtttaaaggaaaaacaatgctttatgccggaatcggcgtgtatatgattgtctgcacgtatgcttattttatggattccgcttttgatttctgggttttggctatgcttgtcgccacttcccaaggaggtattcaggcgctgagccgctcttactttgcaaagcttgtccccaaacagaacgccaatgagtttttcggattttataatatcttcggcaagttcgcttcgattatcggcccgcttttgattgccgtcaccgcccagctgaccggaaattcgtcagccgccgtgttcagcctgattttgttatttgtgatcggcattgccatccttgcgtttgtgcctgaggaaacggcgtaaaaaaagcctgcacgcggcaggctttctattttatttcttggctttatggactttcagttttttgcctttgaccgtcgtatttttcatgatgtcaagaacgtgcgggccttttccgttcagaatttcgacgtatgttgcgttgtccagaatcgtgataatcccgatatcatcggctgaaacgccgtcgattttcgcgatcgtcccgacaaaatcgaccgctctgagtttcttctttttcccgccgttaaagtacagtttcatgatgtctttgtttaactgttcgcttttgtctgttttgacatcggggcgggcgttcaatttttccgcaaaagccgctttccgttccgctgtttctttctcggacggcgcctcccgcttttggatgcggaaaccgatatatgtctcaatgtcattcagaaaccgcgattcagccggcgtcacaaacgtaacggcccgtccgcggtgtccggcgcggcccgttctgcctgtgcggtgcacatagctttctttttcaagcggaatatcataattgatgacgaggctgatgttttcgatatcaattcctctggcggcaacgtcggtcgcaatgagatagcggaactcgccgcgcttgaattcattcatgacgtcaaagcggtcttcctgcaccatgccgccgtgaattttatcacaagggtagcccagcctgtccagctcatcggttaactggatgaccctttcttttgtccggcagaatatgatgcagctgtccgggttttcggtgatcaggacatcacgcagcaaagatgatttatcctcttcttctgttctggtgacaaaatgctcaatgtcttttgtcgtcaggccttccgcttttacttcaatcaattcagggtctttcatatatgtgcggctcagcttctcgacgtcatccggcagcgtcgctgaaaacaacatggtgactctgtttttcggcagatgctgaatgatggcttccacctgttcaataaatcccatattcagcatttcatccgcttcgtcaatcaccacatacgccagccgttcaagcggcagcgtccctttttctatgtgatcaagcacacgtcccggcgttccggcaacgacgtggcttttttgcttcagttcggttttctgtttgtcaaaagaagcttttccgaaaaccgccgtggcttttatccgtttgaaacggccgatattcgtgatatcttctttaatctgcgccgcaagctcgcgggtcggcgttaaaatcagggcctgcggtttgttttcctcccactccgcaagctcgcagatcggaatgccgaaagccgcggttttgccgctgcccgtctgcgatttgacgacgaggtcttttttttgcagcgcggcggggatgacgcgccgctgcacttcagtcggctcggtgtattgcaagccattcagcgcccgtcggatctcggggctgatcgcatattcattaaactcattcatgactaaactccttctctgtccggctcccctcattatacgcgaaatgccgccgctttaccctgacgttttgccgggccgttcgggggactgctttttcttcatgtcgagcacgacccatttggcgcaataaaagctcatacttccttccccgtcatcgacatagtagcggatcgattcccagccgccgtcgactgggctgatatccagatggatgtcggtgatgctttcaagatcatccagccgggcagacctcacatcctcaaaccgcagcacggcatcatactgtccgtcagtcagcttcagctcaaacaccgggattttatcataatactcgttatacccggtatagaacgtaaactccgtcaattcaaaacaacccggcgaacctggccccggcagaactgctttctcatgtttgtgccattccattttgcgcctcctttttttcagctgaattgacatgtctgactcaaatgaatttttttcttacaaatccccatgaacttctttatattcctgcacccaatctcttaattcttctatcgtatgcagatacgcatcaggcgaatctttcagatcaaacccgctcaaatatacgagcatctcccaaacggtttcgtcctcatccgccggatcacctgcactcacatactcagacgcccaatccgacacttcttccctcgccgcttgaccgttcaggatcagaccagcctttttcagacattctgctcttgtgggttctttcacgtcaaaatcctgcctttcatttcttgtttaaaatgctgactaacagcctcctggcccgttcgtgccgcccgatttcctggctgagctccggataatccatcaaagcgtttttcagctgcgcatattgcggatacagctcaaaaaaggatttatataaggctttacgctgccgtgcaggcatttgtttattcgccaaaacaaaatctaagctgccgcagacaagtgcgaagtattcataaaaatccccagcgcaggcagcaccctcaaagtcttcttcgaatctccctgcatctgaaggcagcggcccctctaattcttttttgtgtaatttcaagcttctgatgacgtcattatttaaagaatatctgttggatcttaacatctcatttagccgctttcccattactgatatcccgcttataaatccctgaattcgagaccgcgtaaatggcatcgccagtcagcttcagctgatgcccggaaagctcatcgccatccgcatcacagcacgttatctcttgcatcggcagactgacatcggccggaatgagagacagtgaatgatcatctttgcatacccaaaacccgttatctgaaatcgctagctggtcgtaaaccccggaatatgctttatcagaaataatccacactcgtttcacgtcggtttcttcaaacgcagcaatgactgtataagcgtaatacagcatgtagattagtccgtctttttctgcaagtgcataacagtcatctaccgcgggcgcatatatttctgaaagctgctgatcaatgtgggttttctttagctgcccgtctaaagtgaagcacagcacactgtgcccttcaggattttcatcactataaataccttcatcacttaaaccgatccacaggttttgtttttcatccaaaagactgcatgaaacccctgaagggagagaaaatgcactttgttctgttccttctgctgaaaatactttcactttatactcatgcgattcaaagaaaatcaacacataccagtcagccgaactctgttggaacagcataatatcctcatacgggatttgttcatcgatatgaatcactcgcgtatcgcccgatttgtcgatgatcgtaaacgaaagcccgccattctgatgccgtccgagatacagacgcccgcagttatcaaaatgacaaaaacatccttttactgattcttcgactatcttattcatttttattttcatgtcattgccccttgagtcttggatggtatcctatttatatcgatcgttcactccgtaaaatgatatgcagatggctgtaaaaagccatctgcataggattgatcaatactttaccagatataaatcgttatcactaaagataaacatgcgatcctgtacggctctgtacgttgtttctccttttctatcaataccgtgtatcatgacgtcagtctctttgtgctcttcatgaaatgcaaatagggtatcatcgtgactctgaatcagcagcaccctttttttcgaaacggatagctgatcacaataggagtattgatcgccgtccagcacatattctgcaacagtacgaattctgtcccgtccaatctgataatgcccgatgacacagcaatcctctccctcgaaacatacatacaaatcagatttgatcgattgtacggcatagcattcgtgcatcatttctttaaaatcgtcttcaaaataaaacgttctgtcttctgcatgaaaagcaaatatcgcttttccttgaggatttctctcatcatacataccctcgtccgttaatccgatccataataatccatcctcacccagatgaaatacattggcgcttaatagaaaagaacaaatcggattgattttattactgtttacgcagtatgcagccaattgacacgtatgattctccaggtaaacgatcacgatagtgtcatcatacgaatcaatcagatagaaatgggcatcttcagaaaatccgtgtaactcttttttgattaaaagagagctgcctttcataacctccaatattactttgtgatcgtgcaccgacacaataaatacttgatcatcccgacccgcattgaaataaatgatattttccctttcatatgacccaacacgctccgcggtaagttttaacatcagcaacactccgttgaataggaacctgaaatttatattaaattaatcaatgatatataaatctgctgcatcgtattcaaaccaaatgattttttcattactttcagtagttacatcaaccttttgagtgttcaggttcatgcaggacttatttttggcagggtttgctattataacaacaaaatcattgatcgatgctaaaaaatataattcatctaataagtaatctgccatcaattcttctttggttaggacacattcaatatgaatgaactttttcgatacagtattcatatttatcattttcttttcaaccttcttcttccattcttcaataaaagaagggaatgccattacttctattagagctgtttcgaactctaagtcattcattaatttgagaaaaagtatctttactcactagatcacatgaataaatcgaattgtatttaagcggattaatcacatccagattccctatagccctcaatgattctttttgtaaatttaaaggagtgttcatgtttgcctccgcgaacgatttcgttatgtaagaaaagagaggctgggaacctctcttatttgtttatttatgatttcggatgatacgcataaaatgattggtcgtcaaagcgaactgtttcagcttctacagcaatcagcattctgttcatgtcaatgagaaaattagcatttgattgatactccggaattacagcatttgatagattaccgattccttccgggtggtaactcatctcaaatacttgccaattgtattcttccgaatctattttttctaatctcatatcaccaatatctgcactaaaataaacagatgctgcatttttaacaacctgaaccttaaaacaggtcttttttaaagaactgataatcgacctttaaaatattacatccctcgtcaatataatctactctattgttcaatttgtttgtgcattgtcttctccttctcctaactaacactaacaaacccattgatagaagtgtcttgatgataaacatagattattcaaacaagccccaaaaatatattactctgcatatttgtcattaaatatctgttgaatgcaaaaatactatctggagattatttgaaatcccgtttagaacaatcagatgatatcggtagtaggtattaaaaatatacttatttgtaatgtgccgtaagtgttttttcaaattcaactggaaccgtctgatttgggaatacaactgatatccaatctaagacaacgccatctaacgatctccaagttgctagttcttttccttcactctgatgatcaatacctagaatacagatttcaagttctctctcaccataaatcgcccactttaaagtcggtgaagcccaaacaacacgagatgcaatattcattatacagtcacttttactgtgctttggataatcagttaagagtgacagatactcatctgcagttatatgcaaagggatctttatccagttaaaatactcaaattcttcgtagaattggtttatatgttcagaactgtctataacagccattaatataaactcatcatgatgttcattagccaaactcttaaacattccccaactttcttcagataatacccaatggaattcctcgaataaataataatttttcctttgcttaaaaacttgtttaggcaatgtttgatctacgtgacataaggaattaattatggattgatagacttttaactccttaggatgatcaataaaatagtgatccatcttatttcccctttaatgtcgcattctgattttgtgtgtgaatttttttctacctttaggtgtatattccgcggttggatagggacttgacttagcatgtttccttagggaatacttattcccatttttcgtcatagtgataacaccccatgatgaactgattttctccatccttgtcttcttaaatttttttcaaaagttcttctttttacattagtagaataatttttgaacctagaagtttttccagttatatccctataacttgagtaggcccttctagcccgtacactttttctagatagtttatatgttttagcagctttataaatccgattagcacccttaaataacttcccaggaccaaagttcgaagccgctgcccaggctgcacctctccatcctttacctgatttatatgccttatatccgtcataagccgcaaagccggcgttaatggctagccacacccaatgcccatctggatcaacattcatcaccgggttgttgtttccgtatgcatatccattctgatctaaagaatccccatcgctgcccgggtctgggtctagtgataagaatacaccgtttcttggttcgtagtagcgggccatgagatagtacaggccggtttcttcgtcgtattggtagcctgcgtagcggtagcggttgtcttttacttcgtcgcttgcttcggtttttgtcggatttccccacgcatcgtactgatatttggcaacggtttttccggtgctgtctgagatggcgatgacgtcgccgtgtgcgttgtagtgatagaaatatttcttgccgttctctgtataggataacagctggccgctgtcaccgtacgtatatgattttgtgacgttgttgtcggcgtctgtttcatacagaacgttcaagctgtctccgtcatagaagtagttcgtaacgtttccgttgacggttttttggattctgtttcctttttcatcgtatttgtatgttgcgaacggcttgtcttcgccttttttcgtgacggcggtcaggttgtcttccgcgtcccacgtatatgtgtatttgccgtcagatatgcggttgccgtttttatcataggacaggtcttcgtcattcaccttcgtcagctggttcatgatattgaatgatgcgttgactgatttgcttgcgccgtcctttgtggtggtgacgtttgtccggttgccgaagccgtcgtacgtatattgaatgacggtgccgtcttcatgagtttctttgacgagctggttgagcttgccgtattcgtactgcacctttccgccggctgagctgtcgatgaccgtgcggttgccgttggcgtcgtattcatagctttcccggaagatgctgccgccgtttttcgctccgatatgaagagagctgacaagattccgctcatcatatgagaagctcgtgccgacttcatttccgctgatgaatgtctggacattgccgttttcatcataatcaaatgtataggctgaagtgccgtctttcatttcaatcatttgatcaagtttgttgtacgtaaagctgtttgttcctttttggccgccgtggctccatgagaaagttttcagcttatctgaatcagccggatacgtccagctttggctgccgccgcggtcggttaattcggtcaggcggtttttgttgtcaaaggtgcgttttttcgttgtattttgttctttgtttgtgaccgacgtttcattgccgtttttgtcataggtaaagttgtatttttcagtgccgttatacgcttttgacttaacccggtcggtgccgtcataggtcagcgacacttcattgccgttggcggaaacggttttcgtcaggttgctgttggcgtcatattcactcttcagtacattgccgagcgggtcggttgttttgacgagcttgcccatgacgtcatattcatattgataggtctggtttgcgccggcccgaatcgtttttgtcagctcatttccttccttgtcatagctgtgaaggatggatgtgccgtttgacagggtcagctttgtcagctggtcggcctgatcgtattcgtaggcggttgtttcgcctttcgcgtcggtttcagacattttcttgccagtctcgtcatatgaagcagtgcttgcataacctagttcgtcttcttcttttgtgacgtagtttcctttttcgtcataggtgtttttcgtcaggatgcttccttcgattaatcggatgtcatcaaaccacgccgttcctgtggcgcttttttggaacagaatgctgatttcgattttattgatcggctttgttttcggaatgactgccgccgcccggttccattcctgtgtcccctgcgggaatttggcggtgtagacgcccgtcgtgccgtccgcataggtgacgccggcctgaagcgcgtaatcattgtcgttcgttaattttacgccgtctgccttggacatccctgtcagcgtgatatataccggcttatcgtccgcgctttggcctaatgtgacggtttgttttgcggccgcattggcttgtgatgcatttgtgcgggacgcttttaatgagctgtcatcatcgaagccttcatcaaggtcagcggcggctccgcttgtgctccagccatctgctttagccgtgaaactgctgttttgaaccgggttatagcttgaagagacttcgcctttttccagctgaacctgatcaaaccacgcttttcctttgccgtccttgtctttatgatccacttccatatagacgatggcttttcctgcattggccggtgttgtaaaggtaatctgccgtttcgtccagtcattctttccggctaatgcgcctgattcattgtgaatccattgaatgcgtttttggtctttgtcacgcagatcaatgttgaaatacgctctcgcctttgtcagatccgttttgatctggccgctgagtgtatacgtcgtattcggctcaagctgcacttcctgcgttgcggacgcatggccgtgctctgttccggctgaagcggattgtgaggtgatctccagtgctttttgtccggacagcgcgccgcttcttgcttttacagacgcgatgcttccgctgtctctcgtagcggtgagattccagcccagctttgttgcttcaaagctgccgtctttcagcaggcttgccgaagctgccagctctttgcttgattgaatgagatttccatacttgtcatacacggcggcggatgaggattttccgctttgatccgtctcagaaacagcatcaagtccgtcgtacgcaatatcagtgacgttcccctcggtatccttcattttcgttacgtcattgtttttgttgtactgatacgtttcggtgccgtagttgtcttttacggctgtgacgttgccgtctttatcatattgatagctttctgtcgctttgcccgcatccgcgtcgttcggatcggtgtcctgaatgacgttgttgccttcgtatacagtgttggtcgtgattttcagcccttcggcatcatcgatcatctgaatcgggttgcccgcctcgttatagccgtactgcactttgcggccgttcggctgcgtcatgagcagcgtttttttgccggcgtcatagctgtaatcatacgtttcttttttcgcattaacggctttggccaggcggtgcccgctgtattggtattcagtgaacagcggtttgtcatccgtgctgtttgcggaatactgcttgacgaggcgcccttcggcatcatagtcgtagcttgtgacgctgccgtcagtatccgtcacctttttgagaaggtctttgtcatatgaatacgaaatctttttgtttttcggccctgtaagagatgtgacatggccgttttcatcataggtaaatgtcagcttgcgccctgatgcgtctgttatggcggtcagctgattgctgtcgttatattcgtatacggttgtgttgttgtgtccgtcaacgactttttgaagcttgccgccttttttgctgaaataagcgttcgtctgatcctttgtttttaatacaaattggtcgcttgtttctgtcagttcgagataaacacccgtcggcggctgatacgtgccgtcagattttttcgtgaagacatgtgttgtcgcgtcctcatcaatataaacggctctgccgtcttcagaaagaatcgacatttccgcatcggcataccagccttggccgaacatatggtcagagctgtcaaggctgttaaaggtccgggagagtccgagcccggcccgcgtccgtcgattgacatatcttcttcattgacgatgacatttcccgtcgcgccgttcagctgtccgtccggaatgtcgataatagaccagaattcttccgttccgaggaattccgcaccttcatggaaaacagggttaaaaggtgccgtcggtatactgtcaccatttgcgtcataggcggtcagcgtaaaggaatagttcttcttccctttgtaattgccgtttgcgttttcgtaaacaggtgaagggtcaagcgccagttcgccgccctttccgtccgtgtgaagctggaattttcccgctttcacttcatcggctgacggccagatgtgtttgttttgggtcgtccaatgatcggtatccccgacatcgaatgattgatagtcttttccgttgtagatgttgattttgtagcctttggcgtttttgactttatcccatatgagattgacataacccgtttggctcgatttcgtgttcgtatagacgtagcctgtcagatttttcggctttgcgatatcaggcagcgccggactagcttccggtgaggcgatcgcttctccgtctttgttataggcgattactttaaatccgtatgttttccggtttgcgtctccgccggcatttttataaacggggcccgggttgatcggcaattccgcgccttttttgtctttcaggtgaagcgcatattttccggcgctgatttccgcctttgtcggccagatgttttgattttttgtggaccaggatgttttatttccgaggtcaagcgtttcaaagcttttgccgttaaagacttgcattttatacccggctgcgcctgatacggctttccaggaaagatcaaaccagcctgtggcgttgttgttattaaagcctttcgtgcttggtttctgaactctgccaatattcggaatgacgggcttggcggccgcagacatggcgccttctccctggtcaaacaccgcgctgaccgcgacccagtaatttttacttgccggatagctgccgccggagtttttatagaccggcgaaggattaagcgctaattcacttccgccttttccgtctgtatgcagcttatatttgccggagtcgatttctgcttttgtcggccagatgttttttccttttgtgctccaagaggttgcattgccgacagaaatggcttgatattctttcccgttataaagccacactttatagcttttggcgccttcagcttttttccagctgatattgaaaagtcctgtcgaatctccgttatgatacgctttgacagacggcgtgtccgccttcggaatcgtgtatgtcacttcaatgtatggttttttagcagagtttgctgatgacatcagcttcttccaatattcttttccgttgccgtttgtgtgaagcttaaagccgtaattggcgccgccgctgttccacgacttgactgcggatgtgacatcgaagcttgcccattggcctttatagacctcggctttgccgatgtttttggagcccggcttgtttttccacgtgatcttggcattgtcgtaattgctgtttacggtgtcgagccaaagccccgtcgcctttgatccgtaataggagtgggctgtgtatgctttaagcgtcgcttttgtcaccgtcatgtttttgatcggctttagattatcaaacttcataaatgcgtagttcgttccggttgtgccgtcataataacctgttttcagcacgtacgctttcaatccggcctcccatttctgcgacgcggcagagtagtttgtcgtcgggtacgcactcatgacaaaggtatcggatgacacggatactgatgtggaaggatcaatagataccggataaacccgcttgggatctttcagccatttttcatcggccgttacatgcagcaagtagccttcgctgtttttttcaagcttgaagctgacatcttctgacctgctgacctcacctgacttctcgtcgagatctgagtcggtcataaaaggcttcggcacggtgtagacgacattgtctttgtcatcagaaaacgcgatcgagccgtcttcctgttctttagcctgaaggtcggttttgatttgaaaggtgaaggaattgtagccttcatatttgtgaagcacaaggtcttcttttatgttttcgttaaatgtgtaggtttgtaaatcaatagcaggaaacacttgctgatacgtaagctcgttgctgtcttccttcacttttgctgaggcatctgtcggagtgattgcagcctgatcggggccttttgcgccggttaatgagtatgtgagcttatgatcaccgtgttcaaatgtagcgtataatccgtttttcatttgcttcagaaaatcggagttcagcactgtattttccgtcccgacatcctttgagccggttttcaattcaggagaaatgtcttcccagtccgcattggcggtttctttcgtatgaatggggtctgtgtagatttcctgtttgtatacaccctcgccctcataataaagttttgaattctcagttctttcagacgtgatctcaccgtcttgattgatatctttttgatcaaacggcatctgctcggatgctttttccgccggaagatctttttccgggtctgctgccggaatggcggcggttttcgcttgatcttgtttttcacgcgtttctgccgcaaatacatcggcaggcgcaatggaaatcataagcgttgccgcaagagtgccggccagccattttttccacttgttcttttttcctattttcataggttctcctccttcttttgtaatataggcttaacaatagtaatattattgaaattgtttatcaatattttcctaggtatttaaggttattttaaggattataggaattttgaaccttttattcatataaaaaaaccgccggctgccggcggttttttgtattatggatagcggagatttgtattttgcgctcccgcgtaggattgggcgaagtttttggcgtcctgggctgaaagcgtgccgtagctgtaatttgatctcggattccagccggtgcgcggtgatttcggggctttgagcgacgggaatgaaccggtgtcggtgaattgggcggtcccgtagtcgtctatcattccgcctttttcatttccgttaccgaaatagttggcttctgagaagacagtcgcgtttgtatgaatggtgaatcctaaattgaaattggtcacatagttgtttttcgcgtgaaaatagccgtatctcatcaggcccggtgaacgcacatagacgttattaaaatagttgttggtgatcgtcatatgcggatagccgatataattgcgtccttcgttatcatcattcggataaccgagaatcaggccgtacagatggtctgtgaatttagagttagacagcgtcacaaaatccgctttggcgccgacatacagaagctttcccaaatcgctgtggctgttcggattgtagctgtgtccttcaaaccacacgtggtcaatccagtaattctgcccgttcgctatgtacatcggaatgtcgttgttgcctgtaatggcggcattatggctgataatgagatttttgaaaatcacattgtttgatccggagccggtggtcagatagatgttggtcagcctgtggctggtataagagccgacgatggttttattggcgccgactgtcacaacggctttccccggggaagaaatatcacttgtgatgacgatggttttgcggtccgttccgcccgcattgtttttcagatcattgagattgctgacgtagacgacggggccgccctggcctcccgatacggcggattttgcttttccgttatgatccttcgcattgccagcgaatccggtaagtccctgcatcacatccggataagccgctgccgcttctgcctgcttggatgcggaacatacgatggccagacaaagcgcaaagccgagtgcagccaagaaagcgagatgacgcgtcttctttttcatgcccttcactcctttaatctcttaaattgcaaacacatgaagtattatacaattactatcctctttttccatgatctgtttgtctgctttttcgttatggctgaaaagccccaaaacaaaaaaagcagccgatacggccgcctatatacgggtgctgtctgcctgagtttccgccggcacggctttttgctttcgaatcagggacagtgccattcccgcaaaaatcaacacaatccccaaagattgataaaggtcggggcgaaaccccgtaaatacggtgtcaagcacaatcgccaccgccggatcaagaaatacgatgattgatataaaccgggtggataaaaaccgcaagctgtcaaaaaagagcaaatacacaattcccgtatgaatgataccggttgacacaatcatgatccagttcacatgcgacaaatcagaaaaagcgccgaaacggacgaacgggagaagaatgataacgcccaacccggtctgcaaacaggtgaccgcatatgggctgagactgttgatacctttcccggccagtgtcgtaaaggcgtaaaaaagggcggccagcacggcccaaataatacccgatcccatcagctgagaaaatgacgtatttccgttgatgccggaaatcagggcggtgcccagaaaacaaatcacgatggaagtgacggacacaatatgcagtttctcccggtatataaggctccctagaagaaggacgagaaccggagccagatgataaacggaaatggctatcgtcactgatgtctcctcaaacgatttaaataaaaacacccagttcagcacgagaaaaaatccgcaggccaatgtctgcaacacctcgcgccggttccattgttcggtgcggtgccgtccggaaccaaaccagcaaacgcccagaaacaaagaggcgcacagacatctcacaaagaccagttcaattgaaggaacattcgtatgttccgagaaaaagccgattgatccgaaaatgaccatggaaatgaccattttgatgacggcatttgatgtttgttcagcttgcattgatttgcttcccccatatcattgactgtttattcagacaaatactaacagccattttacttgattcagaggaagatttcatcctatttttcgaaagacggcggtcttttctcattaaaaaaagccccgcatcagcagggtcttctgtttaatgaacgatcagtacaggacaaggagacaattgtgagaccttatggctcacgcttccgagcatcatttctttaaatccgctgattccgcggcttccgacgacaatcagattgaaatgctgttctttcgctatgtttaaaatttgatgcgcaggttcgccttggacgtacaggctttccgcgtttaccccgctttcagccgctttctgcttggcattttccagaatggccgctcctttttgctcgacttcatgtttgatgtcttcaatgaagttttccggaacatagacaatccctgttaaggctgatgtggagacaacggcttcacgtcccgcataaagaatggtgagttcagcctgctgttctttcgccagatggatcgctgcgtccaaagctttgctgctcatgtctgaaccgtctactgctgcaagaatttttttaaacatatgaatcccgcctttctgcttttattgtcctcctctctttgctgaatgtcaattttgccggctttctccggaacattgcgcttacagactttctccgtttgtggcgatgacgtctttataccaaaccaaactacctcagcgttattttttaagcgcttaataaataggactttattctcttctttttcagtattacctattggtaaaagtagtgataaaatggaattattgatataaaaaaggagattatgatgagaaatcatagaggcttccatgaggaaattcagcaacaacaaaaactttatccaacatcacatcgcattcaaccggtcagcccaaaagaatatgcagaagttttgactttacatacggcaaaacaactgagcgagacatttcaaacacttgtggatcaagatcaatatgaacaagcgattcagctgagcgagaaggtcgcctctcagcttggaaaacatacgaatttttcattgccactttccacagtgctttatagtttaaatgaaatggaacttcctatttcagaggaattttctctacatcgtctgaaactgctaggaaatcatcaaactcatgagaactttttcaaagcaataaaacacgaaatgttaacggcggatcgggtagactttatggttagtttcacaaggtggtctggtgttcagcttttgatccctccgcttcaggagcttgctaaaagacatgtccctgtacgcatcattacatctacctatatgggtattacagaaccgaaggcgttaagacatcttcttcaatttgaaaatgttgagttgagaattgtaaatgaatataaaaaatctttccatacgaaagcatacttatttgaacgctgttctggacagcatagtgtcattgtaggatcttcaaatctatcacaagctgcccttacgactgggtatgagttaaatgtgagactacctgaaaccagatatctccccgtttatcaacaaacaaaagatttgtttgacactgtttggaatgaaaagacacagcctgttgacgaacaatttttacaagcctatgaggaattccaagctggaagccaaaaggtaagtgcttcctttgctgctcaaaactctctttacaaaacgaaaatgtccccgaatgccatgcaaaaggaagcattacgaaaccttaaaaaaacaagaaacgaaggggagacaaaagcagtcatcatcgccgccactggaaccggaaaaacatttttagcagcatttgattttgagcaatttaaaccaaataaatatctttttcttgcccaccgggaagagttactttcaaaagcaatcgaaacattcaagaaagtcacaaataatcatgaagattttggcttattgactggcacgaaaaaagaaagagataagcgttttttatttagcactatacaaacgttacataaaaaagatactttggaatctttttcaacagatgagtttgactacattgtgattgatgaattccatcatgcagaagcatctacctatcaagctgtattaaactactttacaccaaagtttttattaggtttaactgcaacaccagagcgtcttgacggtaaagatgtgcttcagatttgtgatcataatgttgtttatgaactcagactccgcgatgccctaaaggcagagctacttgcgccatttcactattttggaatttcagatcatactgtagattacgaaaaagtaaaagtgaaaaacggactgtacgaagagaaatcgctagtcaatcatttaaaaacgcataaacgagtagaatatatcatcaagatgatcaacatgtatggattccacggcgagaaaatggttggcttaggtttctgtacaaacgtcgaacacgcaatatacatgagtgatgaatttaataaattgggtttttatacaacttatttaacaggaaatgattctcctgcaaaaagacaagaggtcattcgtcaattagaggacccgcaccacagtttagaacttatatttacagtagatattttcaacgaaggaatagatatcccaaagctcaatctactattgttccttagaccaacggaatcaccaacgattttcattcagcaattaggacggggacttagaaaaactgacgacaaagagtttgtaacgatactggattttatcggaaactatcaaaagtcattcgttattccactcgcactatctggacaaacaagccaaaaatcttttgataaagattccctccgagtggccgtgacgcatgagttttcagatttacctggaggatcttatgttgacctttcagccataacgaagaaagaaattttaaataagatcgatcacattaaactaaattcagatgccatgctgaaaacgttatacaagcaatttaaacaagagctagggcgctctccagaattaattgattttctatactctgaacaggcacctgggcttaccttttttataaagaaatacaaatcgtgggtacagaccaaaaagaaaatggacgatttgaatgttacagatgaagggattctcaataaccccttggttgtagggatagtagcaagattagaacagcaattacctattaaatggccttatgaatggttaattttacagagcggttttcacaaaaatatcatcacaatagaagatgtaaaagaatcgttagaaaaacagtttcatattcaaatcacaacagatacacatgatgacctcattcagcgagcaatggagcgtttaacgaaatcagatcaaaaacagaattggcgctttggtacattacaaggtgatacattcaagttagatccagaagtaagcgagattttaaccgatccattattcggaccgtatattaaggagcgcgtccactatggactgattgaatttagacgtatgaacaatatagaagcccttgcttcaaaagagattaagctaacattgtatcagacctatacaagaaatgagctcatttatctttttcagtcaactgatcaggaagggacttggcgagagggtgtacgtagagttaaaaatcactatttaatctttatcaatttgaataagtcagaaaaagtagaagatcatttgctatataaagattattttattgatcctagccattttcactggcaaagtcaaaaccaaacctcacatatatcaagcgtagggcaaaactttattcaccataaggaaaaaggataccatattcatttatttgtgaggaaattcactgaaatgcacaacatcactttaccatttatttatttaggagaagcggattacgtatcaagccacggagacaagccaatgaatgtcaaatggaagctccatcagcctgtcccagaaaacttgtatgtggatttaacgaattaaagcagatacggtcggaagatcagcgggtgcccactctagtgattctagctcacgaataggcacccatctgaattccgcatgctcttttgctaccggcttccctgatacaatcctcgcttttattgaaattaaattgacgatgaccttctcatattcatgatgaatatcagctatcacatcgcccgtaacaattttacaatcaagttcctcttcaatttctcttacaagtgcttcccgagcattctccccttcttcaagctttccaccaggaaactcccacagattaggaagagacattgttggagaacgtagagcacatagaatttcattgttttcattttgtataactgcggcggctacttttattgtttttttcaaaattaaacttcctttcgttttttcttaggtatgtattcatatttttgttatcaattttatactgttcactgtaaacgatagaggttgagtccatcataattcaaatggtttattaaaagcaatagaaggtcattctcctaattagcaagaaaaaagcaccctccaaactggagtaggtgctttttcacttcactccccaaacagcctccccatcaccgctcagcacactaaacgtcacaacttctttctctctcgctgagtcccattctttcaggaagacaccgtcataatgtgtgccgttcaggttgattcgggctttgctgctgttcgttattgtccaggttccggtcatttccccggaaatggtgccgtcgttgttaagccggatggtttttggggttttgatcgtagctgtaatgtcttttccatgctggatgagtttgtaggctccggatgcggcggctgccgatatgtgtgtatccggttctcctgcgtagcggtacggcgctgcaacgggccatccgtctttgttcatgtacagccgatgcactctgacttcgtgctcttcgcctctgttcgggaaacgggtgtggaaaatgaggtatgatcgtttcgttttcccgtcgtaaaacacggagttgtgtcccggtgaaacgtagcccgtgcctttttcagattgtgaggcgaagctgtagccgcccatgagtttgaccccgtacggttcaattgctttgtcatcgaagaaactgccgtcttttcctttggcgtcaagcatgttatggcctgcggcgtcatagtacggaccgtccggatttttagagcgcgccacacgcatattgtagccgccggctgtgtcaagtccgccgaatgacagatacagatagtaatatttcgtttccggattgtagctgatgtacgggccttcgattctgctgtgatttccgccgagcagtttttttccgtagccttggttcgggagcgggaaaccggttttcggattcatttccagtataaaaatccccccggagtaagagccgtacaccatccagagcttgcctttatggtcaaaaaacgtttgcggatctacgacgttcgggtgaacgtttgcatgatacgtcgtgccgtcttcgctttttccttccatgcctgatttcaaaaagatgcctttgtttttgtagggtccttcgattttgtcactcacggcgacaccgagagcggatcgcggcgagtctcctttacaggcgttatagtacatgtaatatttcccgtcagccagctgagccacatccggcgcccacagcgtatcagactgggcccagtcgaatgtctcttttaattcggagtagacgttcgggatcaggggattattgggattgacgcttgaagacagttgctgccactgcatcaggtttttcgacttggcggaagccaaatgcgagccgaatacatagtatgtatcgcctgttttgatgacggacggatcatgcacgctgacctctgaaaaaacgggatgctgggcttttgcctgcggcagagtgaacccgataaccgctgctgagaccaggcacacacgaaagaaactggttttcattttctgaaatctcctcgctctcttcttttcttaaaacgctttcaagacaacgctctattttatgacgcggatggcggaaatatgtgatcaacagcgccggcttcccgatgtaccgctttaatacaatagcaatctgatttgtgaaagactggaaaaaaagttttgacttctgattcgcaaacacttaatataaaaaacagttactagttatcagaatatttaagaattgagtgaagcatatatgaccttacacaaagaccgccgcatcgggcgattgtccgtccttcttctgcttcatgagactgaagaaaaccagcagatcagccggctggaacgggacggctggaaagtctgtctcggcagggtgggttcaatggatgcgcataaggtggtagctgcaattgaaaccgcttccaaaaagagcggcgtcattcaatctgagggttatcgcgaatcacatgcgctgtatcatgccacaatggaagctttgcacggagtgacgcggggcgaaatgctgcttggctcgctgcttcgtaccgtgggcctgaagtttgccgtcttgcggggaaatccgtatgaaagcgaggcggaaggcgattggatcgccgtttccctttacggcacgatcggagctccgattaaggggcttgagcacgaaacattcggagtcggaattaatcacatatgaatcagcccatagatatcagatgatagggggctatgcgtgaaatatcattttcatggcatagctcctttttgtatgggcgctttaccaaagtaaagaaaaaggggttgaaatgatggtaacgttagacggttcctcactgacaaccgcagatgcccagcgtgtgctgtttgattttgaagaggttcaagcatctgccgaaagcatggaacgtgtgaaaaaaagcagggcggcggttgaacggatcgttcaagaagagaagaccatttacgggattacgacggggttcggcaagttcagcgatgtgctgattcaaaaagaagacgccgcggatctgcagctgaatctgattctttctcacgcgtgcggcgtcggtgatccgtttccggaatctgtatcgcgggccatgctgcttttgcgcgccaatgccctgctgaaaggcttttccggcgtacggactgagctgattgatcaactgctcgcgtttctcaatcatcgcattcacccggtcatcccgcagcaagggtcactgggggcgagcggagatttggcgccgctttctcatctcgcactggcgcttatcgggcaaggcgaagtcttttacgaaggggcccggatgccggcagctcatgctttggaaaagacaaaccttcagccggccgtcctgacctctaaggaagggctcgcgctgatcaacggaacgcaggccatgaccgcgatgggactgatcgcttacctcgaggccgaaaagctggcctatcagtcggaacggatcgcgagcttaacgatcgaaggccttcagggcattatcgatgcgttcgacgaggacattcatgccgcccgcggatatcaggaacagatggatgtcgcagagcgaatccgctattacttgtcagacagcaagctgacgaccgtccaaggggagctgcgtgtccaggacgcctattcgatccgctgtattcctcaagtccacggcgcatcatggcagacattagcgtatgtaaaagaaaaattagaaattgagatgaatgccgcgacagataacccgctcattttcgaagacggcgccaaaatcatctcaggcggaaactttcacggacagccgatcgcctttgccatggattttctcaaagtggcggcggccgagcttgcgaatatttctgaacgccgtatcgaacggcttgtgaatccgcagctgaatgacctgccgccctttctgagccctcagcccggcttacaatccggagcgatgatcatgcaatatgcggcggcctccctcgtgtcagaaaataaaaccctggcccatcccgccagtgtcgattccattccttcatcggcaaaccaggaggatcacgtcagcatgggaaccatcgcctcaaggcacgcctaccagatcatcgcgaatacgagacgggtgcttgccgttgaagccatttgcgcgctgcaggccgtggaataccggggtgcggaacattgcgcctcgtacacaaaacagctctatctcgaaatgagaaacatcgtgccgtccatacaagaagaccgcgtgttttcttatgacatcgaacatctgagtgactggctgaagaaggagtcttttctgccgaatgagcatcaccaaaaactgatgaccaatgaaggaggacttacaagatgactgatgtaaagaaatcaatccgcgccggccgcggcaccgaacttgaatgcttaggatgggagcaggaagccgtgctccgcatgctccgaaacaaccttgacccggaggttgccgaaaagccggaggatctgatcgtatacggcggcataggcaaggccgcgcgaaactgggatgcttttcacgcgattgagcgctccctcaaaacgttaaaagatgatgaaacactgctgatccaatccggaaaaccggtcggactgttccgcacgcacagccgcgcgccccgcgtcctgctggctaattcggtcctcgtgccgaaatgggcggattgggagcatttccatgaccttgagaaaaaaggactgatgatgtacgggcaaatgaccgccggcagctggatttatatcggttcacaaggtattttgcaaggcacctatgaaacctttgcggagcttgcgagacagcatttcggcggcagtctgaaaggaacccttacgctgacggccggacttggcggaatgggaggcgcccagccgctgtccgtcacgatgaatgatggcgtcgtcatcgccgttgaagcggatgaaacacggattgataaacggatagaaacaaactattgcgaccggaaaaccgcatcaattgacgaagcgctgcgctgggccgaaacagccagacaagccggagaacctttatcgatcggccttctcggcaatgcggcagaggtgcatcatgagcttttgaaccgcggcgtccatattgacatcgtgaccgatcagacttccgctcacgacccgctgatcggctatattccggcaggatactcacttgaggaggccgaccgcctgcgccgggatcagcctgatttatacgtaaggctttccaagcagagtatgaaaaagcatgtggaagccatgctcgccttcaagaaaaaaggggctatcgtctttgattacggcaacaacatccgccaggctgccaaagatgagggtctcgccgatgcttttgattttccgggattcgttccggcctacatccggcctttattttgtgaaggaaaagggccgttccgctgggctgcgctgtccggtgaccctgaagatatataccgcacggacgctttattaaaagagctgtttccagaaaatcaagccctccaccgctggattgacatggcgcagaaaaaagtcacgttccaaggcctgccgtcccgtatttgctggctcggctacggtgaacgggaaaagatggggctcgccatcaatgaattggtcagaaacggcgagctgaaagccccgatcgtcatcggaagagaccatttagactgcggatctgtcgcctctccgaatcgggaaacagaagcgatgaaagacggaagcgacgcggtcggcgattgggcggtgctgaacgcgctgatcaacacggcctcaggcgcaagctgggtttcttttcaccacggcgggggcgtcggcatggggtattcccttcacgcgggaatggtcgcggtcgctgacggcagcatccttgcggaacaacggctttcccgcgttctgacaagcgatccgggtatgggcatcatccgccatgcggacgcaggttatgaaaaagcggttcaagtcgccgaggaacaagacattatgataccgatgaaaaaggagcggtaacatgccgaaacaaatagataccatactcaccaacatcggccagctgctgacgatggaatccggcggcccccgatccggcgggagcatgcaggatcttcatgtcacggaaaatgccgtcatcggcgttcacgacgggcgcattgtttttgccggacatcaaggagcggagaaaggatacgaggcaggagacattatcgactgcgggggacggctcgtcacccccggcctcgtcgatccccacacccatcttgtattcggagggtcccgcgaaaaagaactgaatttaaaaattcagggcatgtcttatttggatattctggcgcaaggcggcggtattttgtcaacggtcaaagacacgaaagccgcctccgaagaagaactgattgaaaaagggctttttcacctcggacgcatgctgtcatacggcatcacgaccgcggaagtaaaaagcgggtacggactcgacaaagacacggagctgaaacagctgaccgcggcgaaaaaactgggtgagcgccagccggtcgaccttgtcacgacctttatgggagcacacgccattccgcctgagtaccggaacagccctgacgaatttctgaatcgcatgctgcagcttttgcctgacataaaagaaaaaggccttgcgcaatttgccgatattttcacagaaacaggcgtctttaccgtcagccagtcacgggactacctgaaaaaggcggctgaagctggtttcggcctgaaaatccatgctgatgagattgacccgctcggcggcgcggaattggcggcagagctgcatgctgtttctgccgatcatttggtgggggcatctgacgaaggcatcgaaaagcttgcggagtccggaacgatcgccgtcctgctgccgggcacgactttctatctcggaaaacacacttatgcgagagcccgggagatgattgatgcgggcgtacgggtcagtttggcgactgacttcaacccgggcagctcaccgacggaaaatctccagctcattatgtcaattgccgcgcttcatttaaaaatgaccgcagaagaaatctggcacgctgtcaccgttaacgctgcgtatgcgatcggaaaaggcgaagaggccggacaaatcaaagccggacgggcggctgacattgtcatttgggaagcgccgaattacatgtatatcccgtatcattacggcgtcaatcatgtccgccgtgtcatcaagaacgggaagacggtcgtttcaagggagggagccgctcttggataagtatccgtttctgcaaaaagccggctccctcttcaacgaccgccatgtgacaaggatcggcgatgtgacggaagcgtgggcgggacaaacgatcaaagggccggctttgatcggcgttccgctttctaagtcgtcaatcagccattccggcgcctgctttgcccccggtgcgatccgccgggcgctcggcggcatttccgcatattccgcggagctgcgggagcatgtcattgaccatctgtacgatatcggcgatattcagattcacgtcacggatgtcgtcaaatctcacgaacacatttatcggaccatttatgatattctgacggaccagcctgactgggtgcccgtcattctcggcggcgacaactccatcagttattccaccattaaagccattgcggaaacgaaaggaacaacggccgtctttcaattcgacgcccaccacgacgtccgcaacacagaagacggagggccgacaaacggcacgccattccgccgtctgttagatgaaaatatcataagcggacaaaacctgattcagcttggaatcagggagttcagcaacagcctggcatatgaaaaatatgtaaaagagcgtcaggcagacgtgcatacaatggagatgatccgggagaaagggcttctccgaacgatacaagacactttgccggccgttcaaaaaagagccgacgccatttttatttcggttgatatggatgtgctggatcaagctcatgcgcccggctgtcctgcgatcggccccggaggcctgtataccgaggaactgcttcaggcggtccggtttttagcccaggaggctgacatctcgggtattgagatcgttgaggttgatccgacacttgattttcgcgatatgacaagccgggcagccgcacacgtcattttacatgcattgaagggatttaaattgtcacgttaaagtcaaatccggcacgcgtgatctcggctgccggaagattctcatgccacgcaaaaagggggagatcacgatggatgttgatcaaggcggcaatcaactaaagcgcacgatgaaaagcaggcacttatttatgatttcattgggaggggtcatcggcacggggctgtttttgagcacagggtatacattgagccaggccgggccgggcgggacgatcgccgcttacctgatcggcggcttgatgatgtatcttgtcatgcagtgtctcggagaattgtcagtagccatgcctgtgaccggttcatttcaaacgtatgcgacaacgtttatcgggccgtccacgggttttatggtcggtatcatgtattgggtgaattgggtggtgacggtaggatcggagtttacagcttccggtatcctcatgcagcgctggtttccccacagcagcgtctggatgtggagcgcgattttcgcggctctcctttttgccgccaatgcattctccgttaaattgtttgcagaaacagagttttggttttccagcgtcaaaatcgtcaccatccttttatttatcatcttaggcggcgccgcgatgttcggtttgatttcattgcacggttcgggtgaagctccgatgctgtcgaatttcacctcacacggcggactgtttccgaacggctttcttgcggttttcatcgcaatgatttccgtaagcttcgccttttcagggacggagctgatcggaattacagcgggtgaaaccgccaatccggcaaaagatattccgcgttcgatccgaaatgtcgcctggagaacggtcatcttttttatcggcgccatttttgtgctgtccggactgatctcctggaaggaagccggtgtgattgaaagtccgtttgtcgcggtcttttcccagatcggtatcccatacgccgcagatatcatgaacttcgtgattttaacggctttgctttcggtcgccaactccggactgtatgcttccacccggatgctgtggtctcttgcgaatgaaaacatgatcagcgcccggttcaaaaaagtcacgccgaaaggcattccgctgaatgctctgctcgccagcatggccgtttcctgcatatccttgatctcaagcatcgccgccccgggcacggtctacgtggtgctcgtggcaatagccggatttgccggcgtcgtggtgtggatgagcatcgccctgtctcagctgttatttcgaaaacattatgtgaaaaacggcggacgcgtcgcggatctgaccttccgcacgccgttataccctctcgttccgatcgccgctgtgatcttatgtttcgcttcatgcgtaggccttgcatttgatcccaatcaaagaatcgccctcttctgcggaattccttgtatgatcctgtgctatctcattcgttttttgagaaagaaacagccgaaacaatccgtccgtgacattcatttggataaaaccatgccataaaaaaaaaggcacatactgatgaggtatgtgccttttttgtcttattccgtaatcagcgtatgaatcagtttcggcgcttccgctttttctgagatgcggatgttgtcatagactttggcggtcacgtcgtcaacgttttcgcggttggcgtaaagggtgacgagcggctcacctttttcgacgttgtcaccgacttttttgcggagcataataccgacggcaaggtcgatttcgtcctcttttgtcgcacgtcccgcgcctaacagcatcgctgcgacgccgatttcgtcagcgacgatttctgaaacgacacccgcttcttttgccggaacgtcaattttgtacgccgcctgcggaagtttggacggatcgtcaacgacagaagcgtctcctccctgattgctcaggaactctttgaacttttcaagcgctttgccgtttttcatgacttcctgaagcttcgttctcgcttcttccaatgtctcagcttttttcgccaatacgaccatttggctgccgagcgtgaggacgagttcgtttaagtcttcaggcccttcccctcttaacgtatcaatggcttcttgcacttccagagcattcccgatcgcaaaaccgagcggctgcgacatgtcagaaatcacggccatcgtctggcggccgacgttgtttccgatgcgaaccattgctttggcgaggttcacggcgtcttcatccgttttcataaacgcgccggctcccgttttgacgtcaagcacgatggcatctgctccggcggcgatttttttactcataattgagcttgcgatcagcgggatggaattcaccgtacccgttacatcacgcagcgcatacagctttttatcggcaggggtcaaattgccgctttgtccgatgacggctaccttgtcgcggttcacaagcttgatgaattcatcttttgacaattccacgtggaagccttcgatcgcttccagcttatcaatggttcccccgtatgcccaaggccgcggccggacattttagcgacgggaacgccgagcgccgcgacgagcggagcgagtacgagagttgtcgtgtcgccaaccccgcccgtagagtgcttgtcgaccttaatgccttcaatggcggagaggtcaatcgtttcccctgaattgaccatcgccattgtcagatcggcgcgctcctgatccgtcatatcctgaaagtaaatcgccatagccagcgcgcttgcctggtaatcagggatgcttccgtccgtgtatccttttacgaaaaattgaatttcttctgttgtcagttcttttccattttgtttttttacaataagatctaccattctcatgatctatcacctgtccttcatttatgttcagtgaatcaatccgacgatcgccgctgtcaggaaactgacgagcgttgcgccgtacagcagcttcagcccgaaccgcgcgacgacgtttccttgtttttcatgcagccctttcaccgcaccggtaatgattccgatagaggagaaattcgcgaatgagacaaggaatacagataccactgcctgtgtatgcgcgctgaaatggaaatcgccggatgagagcgtctgcatcgccacaaattcattcgataccattttcgtcgccataatgcttccggcgctcaccgcttcattccacggaataccggttaaaaacgcaaacggcgcgaatacatatccgagcagcgcctggaatgtaatgccgaagaccgcgttaaaaacgccgttgaccagggcaatgagtgcgacaaatccgatcagcattgccgctacgacgacggcgactctgaatccatccattatatactcaccgagcacttcaaaaaaggattgcttttcttcttcaggaacgaagatcaaatcctcttctttgctgacggtgtacgggttgatgatagaagcgatgataaatccgccgaataagttcagcacaagcgccgtcacgacgtattcaggcttcagcatcatcatgtaagaaccgacgatcgacattgagaccgtcgacattgcggacgcgcaaagcgtgtataagcgctgttcagtaagatagccgagctgttttttcaaactgataaagacttctgattgccctaaaatcgcggatgcgacagcgttgtaagattcgattttccccattccgttcaccttgcttaacgcaagaccgatatacttcgtgatgaagggaaggaccttccaatgctgcagaattccgattaaagcggatataaagacgatcggcagaagcacgctcatgaagaacgtcgtctgtttcgcattcacaagcccgccgaatacaaagttaatcccttctgatgcatattccagcaagtagttaaatccttttgcaaaaccgccgacaagaaaattcccgataccggtgttgaggagaatataaccgagaatcagctgcagcacgagcatgacggcgatcggccggattctgattctttttttgccgttgctggcaagccaggcaagacctaaaaacacaatgattccgataattccgatgagatacttcatatgtgttctccttttatttgtattcgcttacaattttttatgcatcaacaaagaaagaggatggcggaagctttcggcttccgcaatgctgattaatagtcgctgctgccgctgtctccgccgctcacgatagagacgcccgcacttgcgccgatccggctcgcgcccgcagcgatcatgctgtcaacatcagcttttgttctgatgccgcctgatgctttgaccccgatgtccggtccgactgtttttctcatgagagcgatatcttcagccgttgccccgcctgtagaaaaaccggtagacgttttgacgaaatcagcgcctgcggataccgccaagcggcacgcacgctctttttcttcatctgtcaaaaggcatgtttcgatgatcactttgacgagcgcttttttatcagctgcttcaactaccgcgcggatatcagcttcaaccgctccatcatcgccgtcttttaatgcgccgatattgatgaccatgtcaacctcagtggctccttttgagatggcatccttcgtttcaaatgcttttgtttccgatgtcgttgcgccgagaggaaatccgataacggtgcaaacgtcaactcccgtgcctttcagttcctccgctgcgagtttgacccaagtcgggttcacacaaacggaagcgaatttatattcttttgcttcttttatcagttgtaaaatatccgctttttgtgtatgcggtttcaaagcagtatggtctatttgacttgcaattgacattgtatgcacttcctttttcctaggatacgtttagaataaccgaattttgaacatatgtaaattggtaattgaaattatgttcatgaattgtcacaattcttgaatgagttttttggccgtatgctgatcagtaatcaaaacgttggcgtactttcctttcagggcaccgtgaatggccttgcattttctgctgccgcccgccaccagaatcgaacgctctttcaatttcaggtcgctgagctcaactccgatcgtcctgccgttaatgctgctgctgcaaatcctgccttcctcgtcaaaaaagcgcgaacaaatatcgccgactccgcgtgctttcagcaattgtttctcttcttcccggaaatagccgagtctgaaaagcagcgcctcatcccggacggttccgaccgtaaacagggcgatattggcttgtctgcccatttcaatgatccgcttaatatgtctgtcccgctcgaccatctgtttcacatcggcgctgtcaaatataaccggcagcggcaaatacctcggcatggtctgaaatgcttcggcgaacagctgaatcgtttctgacgaatacgtattgacattggaatgactgatgccgcctttcagctgcacgacttcaacgctctttacctgcttcggctccatgcggcttgcgatctggtacatcgtcgtcccccagcttacgccgagtatatcgccgtcctttacggttttatgcatatagtctgcgccatagcggcttaagtaatgtgtaatggcctggtaatcgtcgcttggagaaaagacgacgtgcgcctcaagcagcccgtatttttcttccagcttcgcgccgagttcatccagatcctcaaacgggtccatgacgcgaatttgcacataccctttttcctttgcgtactgaagcagccttgaaacggtggggcgtgacagattaagccgttcggcgatctgctgctggctgtaatctgattgataatatagttttgccgcttctatgctgagctgctgtttttcacgatccatgtcgcgcctcccctctccgcttatcatatcaccaaaacacgcggtaaaaaagcaccctctgatggggtgcctattttttcagcacaagctcctgaatcgcgtgcgccacgccgtgttcgttatttgatttcgtttcataatcagcaatctcccttacttccgggatggcattggccattgccacaccgcagccggcccactgaatcatggacatgtcgttgccgttatcgccgattgccatgacgtctttctgttcaatgccgagtttttcggccagcagcttgaccgcgtttcctttactgactttcgggtgaagaatctcatggaagaatggcgcgcttttgaccattgtgtatgtttccctgaatgattccggaatagaagcgatcgctttctccagcttgtccggatcgtcaatgaacatgactttcggaatcagaatatccttcggcacttcatcgatcgtgcggaaatgaagcggcactttcgtaatgtatgattcgtataccgtgtattcactgatatcccggttcggcgtgtacagattggctgtgtcaaagtaatgcatcggagtatccaactgtaagctcagctcgtaaagcgactccaaatcttcaaagcctaatgactgctcggccacgacaccgtttgtatacgtattttggacgagtgcgccgttataggcaatcacaaagtctccttcttcctgtaagttcagctcttccaaataccgacgcacgccgccgatcggccggcccgtgcacaggacgatattgaccccttccgctttggcggcatcaagcgccccgcggacttcagccgtcacttcatgatgatcgtttaatagtgttccgtccatatctattgcgattaacttgtacatcctgcatctcctttgtatccttttctgcttatgctttcatcatatcgttttttcgtttcaatgaaaaatcaaacggacaagtttctccgccttctcttcctataccgggcctgcctccggatgcggggccgtcttttccccttgtcagcttgttcgccgctgtcatctgttttctgcttcaagagcatcagccccgccgcaaagaaagggacggccgctatgtccagaagggcaagctttattcccatcgctgcgggaaagtatgcccataatgaacggctgttccgcctgatcatgatataagaaacgatttccagcaggataaacagagcgttcacccacaagtaaatgagcatcgccgcaaacagaaacagcaggagcgtattccgcagcgtgccggaaaacagaagagcgcgcatcatatcaaagaatgaaaaagactgcatgctgccgttgacgacattgggattataaatggtaaaacgcccgaactgatcaaaaagcataaaaaataaccataacagtgaaaaccattgaatgatatgtacgatgacacccgtcaaaacgagtctgtcggcagccttatttctcatgtgcatcctccccgccggtttttattcttgtcattgtttttgtttctccgtatatcttccaaatgagcgtatcgttttttcctcttttcaacgtgcttttgacggggtgcggatgtccgaggtattcaatctcgatcgtcccgtccgtgttttgtgagaccaccttgtaagcatctgagggcatgggaacctcgccgcggcctttaatgacctgctttgtcagcacgctgtctttcgtaaacgtaacggtttcagatctgaccccgtccatcgggcccggtttcagccccgcatcccatgtcccgtaataaaaagggggttcgtctgctttcttttgcgagcagcctgttatcatgacgcatccgataacaagaaccgtcatgatgaaaatccgtatgttccgcaacatgatcaccttcctttgaagctctttttacgcctgtaagttaggcggatgccgtggcactgtgcaattgactacatagtgtataaagacttcactagataaggagaatgatgaatgaacccatatcagtactacaccccatctgcctatttccctcagcagcaggaatacgaagtgagccccgttgagtatgagccgtatcagcagcaggaaagctattattatgcgccccctcagtctgaagagcggcagccgacggctttagaacggagagtcgcccagcttgaaagacaaaacgcccagcaaacgagagagctcacccgcctctcacaagaagaccagcgccaaaaccgggaaatcacgcgtatgaatgagcagatcagacggctgagccagtccattgaaatccatacccgccgcttaaaccgtttgaatcagcgcctgcgcgcagtcgaaaacagactcaatattccttttcacgctacagaaggcggcttctgagaaaaagggccggaatacaaagctcgacaggccatcccgagccttgtattccgctctgtacataacaggtaaatatttgaatccttttcttgcatgaatgcctctcctattctttcacatgataaatgtgtaaaatcaatcacttcaggaggtcttcatgatgtatcaaaaccaatacagcggaaatcagctgcagcaatgccgtcaaacagcacagcagcttattcagcagacacagcaaagcagtcagcagtacaagcaaatgctccagcaggaacagcaaaacattcaaatgcttcagcagatgcttaaccatgaacagcatgccgttcataccattcagcaagcgctgcaggggcatgaactggccattcagaaatgccagcaaatcgtgaatgtgtgcaatcagcttcagcaggaagtaagcggacacatgcctgcaccgatggcaaacgctaatgtttcttcattcccgcaaacacagcatcacacacaccgtttcagcagcattcataccagcaataggccggtcatgcaaatgacaaagcgcgagataccggctttgtcatttgtttttatctctgttttgtcagatcaatgcgttgagcgggttttccgccgaatttttcctccgcctcatgccttaccgcttcaaacgctcttgcttcgacgttttgtttaaacacatcaagctgtattaaataagccgcccgcactttcagcccgtggatgatggagatgacccataaaggcagcacgatatacacgcccggcgtgctcggcagcacaaaagcaattgctaaaataataaaatagataagtccgtatttcagccattttttgttcttggcccggtagccgatatagaaaaaggccaagaaagcggtcagcccaaacggcgcgaaagtcagcagcagccaccagctgtgcagcacttcccaccaagtccctcttttcgtaatcaacattcattcctcctcctttactactataacatggataatcaaggaaggttttctataaaaaacatagacggaatgacgtcttcctgctatattaataatgataatcattatcaccgaaataggggatcattatgaagaaacaatcatggctgatcggcctggcacttctgcttgttttcgcattaagcgcttgcagcggcgcgaaggaaaacaacggatcggcatcaggcaaaggaaagacagacatgcgtacatatgaatcaacaaaaggaaatattgacatacccgcacatccaaaacggatcgtcactgacttttatgcgggtgagctgctgtccgttgacgcaaatgtcgtcggggcgggctcatgggctttcaaaaatccgtttatcaaaaaacagctgaaaaacaccacggacatcggcaatcccgtcaatgtggagaaagtgatgcagctgaagcctgatttaatcgtgctgatgaaggatgaccaatacgagaaactatcgaaaatcgcaccgacgattgtcattccttttaacaccgcaaagaatacgaaagatacggtcagcctattcggcgacattgccggggcgaaggataaagccaaaagctttatggcagacttcaacaaaaaggctgaagccgatcaaaagcgcctcaaaaacgtgatcggcaaagacgagacagtcggcctttatgaaacgacggataaaggcgaaatctggatttttaatgacaattccggccgcggcggccaagccgtttataacgcactcggattgaaagcgccggccaaaatcgaaaaagacatcatgaaaacgggcgccatgaaacaggtttcccaagaggtcatccctcaatatgcggctgattatatgttcattaccgattacaatccgaatggagaaagcaaaacatttgagcgtctgaaagagtcatccgtttggaaaaatctcgatgccgtaaagaacaaccgtgtctttatcaacgatttcaacaccttctatccgtatgacccgattgccgtcagcaaacagatggatatcatcaccgacatgctgatcaaacgggctgaagaaaataaaaaataaaaaataaaaaaagcggcacagtcatgacactgtgccgtttttcatgttcactttaattttgactgtacggagcccggcatatcttcaaatctgacttcttcccaggtctcgacatactttcctttcgccttcaccttcaaatacgcgttcttccgaaggtctttcccggcgaaaaaggtcacttcttcttttttcccggatgcgttatatccgtctaatgtatactcagtaccgcccgggctaagatgtttgccatctcgatcaatctgtacataaacatcttgctggtgaataaacggattaaatctgtctgtaacatcattatgaaaaaagagaagtccgtatatgacggcagcggctgctaagacggccaggattgccaatgcttttttcatctgtgcactccccttacttgttcatttttttcaaatagcttgtccgcaccgctaggaagaacagaagctgaaagatgaaaaaccctccgatggtcagactgagcggccccgctacatcggaatagccttccaccgctaatgttctcaaagcaaacagcgtatgcatgacggcaatgacgaaaggaaagaaaaagagaatcgccaattgtatcgtcacgctttgtgccatttcacgctcactcagaccgattttggccaatgagcggtagcgctcccggtcctcatctaaatcggtgaacagcctgaaatataagaaactcgctgccgcgacaaagaaaacgatcgcgataaacaggccgatgaataaactcaggctcggcagctgcaccgtatcatagtacgtcccggcttttgccataaaatcagaatgcacgtcgatatagttgccgtaaatctcatttttcaaggattggctgatcccaagactgtctttccaatgatcatagctgtagccgtataatgacgctttctcaccgagtgatttcagctgatcaaaggtttgatcgttcaccgcgatgatggcattcaatgaaatcagcggttttttgacttcttttaccgtcagtttttggtcagacggcttgcctttttggttcagcagcttcagctgatccggcgcgtcgtttttgaaattgcggtcatacgtgcccgggaaatagacagcctcattatgtttcaggccgttcagcttaacatggaagtatgttgatacatccgattcgctgatcatataaacagggggaacagtttctccttcctgatagcgaacataggaaacatctattttgtctttcttatacgtaaagccgtgtgttttcagttcatggtcaatatctttcaaatgagtctgttctttcgggttattgctgaaagataaatactccatctcataggcggactcttccgccccgacggtcgatttgtacatcgcgagcacgcccgtcgccgtaaaggcaaccgcggaaataatactgacgataaagaacaggcgggcgttgtcttttaaacgatagacaaggtcagaaacccaaataacatttttcccgcgcagataaaaggttttccacttcttcagcgcgcgcagaatccagatgctgctttggctgaaaaagaaatacgtgccgatgacggtaagcagtaaaatgatgaacggctcggtcccgtggacattgcctttcagaaccatgccgtacccgccgcacaggcaggcgatgccgaataaggacagaagcacggacggcttcggctccggcttgatcttgtcagtgccctttattaatttgatcaccgtatttgatctgacaaaaaggatcgtgaactgcgataaaaggaaaaataagagcagaaatccgccggccgtaatgccgagcgctttccaaggcatgtacagaggcagcgcgtccatttctaaaatataagcgccgaccgtaaagaacgttttcgaaaaaatgaagcctccgataatccccgctgcgatcgacatgacgccgatgatcatgttttccgccgtaatgagctttctcagctgcaccggcgtaataccctgcatcagcagaataccgaattctttatttctcgatttcaaaaatgcgttaaccgaatacagaacaaataagaaagaaaaaacaaagatcatccattccgcggcggttaagccttttttggcgatgttattcaggtagccttcctttagtgccggatgaaacaggaacatcgcaaaggtaaagaaaatcaaaacggaaaaggcgctgctcaagaagaatgcaagataggcccttttgtttctcgtgacgtttttataagcgaactgaagaaaggtcatttgcgtttccccccagcatagacagcacatcaagaatctgctcataaaagacttggcggttttccccgcggtaaatctcattaaacagttcgccgtcttttataaagatgacgcggcggcagtagcttgccgcaaccggatcgtgggtcaccatcaaagccgtgacatgatcatcctgattcaggctctgcatcgtttccatgacatcttttgacgctttggaatcaaggtttcccgtcggttcatcggccagaataagtgacggcttatgaatgaccgctcttgcgatggcggcccgctggcgctgtccgccggatacttcaaacgtccgtttattgagcaggtcctcgattccgagctttttcgcgatgccgtgcagtttttcttccatgacagacggcgcttctttttcaagcgttaacggcagcatgatattttcaccgattgtcagcgtgtccagaagattgaaatcctgaaacacaaatccgagctgcttgcggcggaaatgagcgagctttgtccgcttcagccggtgcgggttttctccgtgaatcaggatatcgcctgaatccggccggtcgatcgttgaaatgatattcaaaagtgttgtttttccggagccggacggtcccatcaccgccgtgaacccgccttcttctattgaaaatgaaatttgttttaaagcttgataggatacttgtcctttataggttttatttatatgtttgacttcaagcatattcgccatgagaatcctccttatggttttattcttgttgatctgggctgctttcatgtagtgccggggcattcagcataaaaaatccccttgacgtaaatccatgttatcaaggggaaacagaatgagctatgttgttttcttaacgcagtcttacatttttgtaagaaatgaaaatcggaccgatgtcccttcaccggggacgagctgatgtccaccgtatgattgagcttgcccgtaatttctttgacgagatggaggccgattcccgtagattcttggaaacgccgcccgttttcgccggtgtaataagggtcaaacacccgcttgatatcttgcgagggaatgccgacaccgtaatctttgacttcaagcatcgtcctgtcttcatcgcggaagacattcagctccagtctgtcactcttgcctgccgaatatttgaccgcatttgtgacgacttggccgatcgcaaatttgagccatttggcatcggtgtaaatctgatgatcatcgcgaatatccattttcggatagacgcggtattgaataaaaaatcgtttatagctttgaatgaccgattggagaagctctgataaggaaaccgcttcgactttaaaatcccgctcaaacaggtcaagccttgatgaataaaggagcgtctccagcccgaattcaatctgccggacctcttttttgatttgttcaaagacgggctcatcctcttcctgaatgattaaattaatgaccgacagcggcgtttttacttggtgcacccattgattcatatacgtcacccgcgcgtcgagcttggcttcggtctcgtagagcttctggtgctgcagccgggtcagctccatctgcttttcatacagctctgaacagaacactgaagaaccgagatacgggatgtccgtcccttcctgctccgagctgagccaatgatacacaccgcggtctttgtaccagcgataggcaagataccccgccaaaataagaagctgcacgcccaatatgtaaaacaggtgggaaaaagaatgaagacccgcaaaccagtaataaaagaagacaaacagcccttgaaggagaaaaagcagaatcagcacggcatgagaccggagaaacagcttcatgacagcgccctcagctggtagccttcgccccgcaccgattcaatggaaacaggcgcgttcagctcccgcagtttttttctgagccgcgtgatatacacgttaagcgtattatcatcgacgaaaatgtcggtgtcccacgttttttccatgagccggtctcttcccgtcaccttttctccccgctccagcagcacttccaaaagcttgctttcttttttagaaagctcgcttttttcgtcctgaaagcgcagttcaaaccgttccacaaagagctgcacaccggcatattcaaccactttctctccctgcttggcggcgtactctccgtatgccctgcggatctggcttttgattttcgccagcacaatatcataagaaaacggtttttcgatataatcatctccgccgttttcaatcgccatcacctgatccatttccccgcttctggctgagatgaaaatgatcgggcttgtagaatgctggcggatctggcggcaccaataatagccgtcataagacggcaggttgatatcaagcagcaccacatcaggcttttcccgcaaaaagacatcaagaacagccgtgaaatccgcggcggccacggtttgatatccgtatttttcaaggtaattctgcaatagtccgcgaatgtcttcactatcttccacaatcatgattttattcaaactgaaccactcccgtttcttacactgctgccatcatcataatcgtttcgggcgtacggacgcaacaccgcacaaaaaaaccgccatcttggcggtttccgttttcatcagccgatctgctgttttacggctttaccggctgatccgaactctctcattttgcttcgcaccgtctcttccacggcttcaaggccgggtgtcatgtagccgcgcggttcgtacagatcgccgttttcctgaaacatgcggcgtgtttcgtctgtccaggctaccatacattccgtgttgatattgattttcgcgtggccgagcgtgatggcttttttgatctgatcctgaggaatcccggatgctccgtggagaacgaggggaatatcagtcatgcgggagatagccgccatttctttaaatccgagattcggctcgccctgatatttgccgtggacggagccgagggcggccgccagcgcgtcgatattggtttctttcacgatccgttcacattccatgatatcggcataacagaccccgccgacaagtccgtcttccatgccgccgaccgtgccgacttcggcttctactgagacgccgtgctttgcggcataatcggtgacttcttttgtcatcgcgatattctcgtcaatcggctgatgggagccgtcaatcatcactgagctgaatccggcgtcaatggcctgtctgcagcgttccgcactgcttccgtgatcaagatggagcacgacgggaacggtaatcgccatttcttccattaacgcgccgaccatggcggaaatcgttttaaatccgcctaaatagccgaccagacgatcggaagccgcggcgatgaccggcgattgctccttttgcgccgcttgcagaatcgccttcgtccattggaggccgttgatattaaattggccgactgcataatgctcccgtttcgcttctgcaagaagatgtttcatggtgacaaaagccatgttcacgcctccttcatgaagtattttgatacgacggcttccgttgtttcctttgccgttttgatcgtttcctccgcagtcagcttataatattcaggtctgaacagctctacggagacaacatcattgaatccgatttcttttaacgctgacagatgggcgtctaagtcaatcgcaccctgcccaggccagacgcggtcttcatccgttaaaaagccgatcggaaagtcttctgtatcgtcgatatgatagatgaaaattttctttccgtccgcctgcttcaagctctcaatattggagcccatcgcgtggaaatggaagctgtcaaacaccagtccgacattatcgcggccgacagcgttcacgatgtcatacgcctgttcaaatgtattgaccgtgcattgcgggtggccgacaaattcaagggcaatgtttacgccgtacggctccgcgatgtccgaaagctcagtcagcacctctatgctgctctttttgatttcttctttcaagattttccgctctgtcacaagcggcacggccaccacatatttcacgccgagcgtcctgcaggtttccatcatttttttgaattccgaaatgatctccctataacccttctcatcacgattgttgaagaaaaccagggcgttcagggcaagcggtttaatatgatgggtatgaaaatattccgccagatcggccagtgaatggtcttttaagtattccggcagcttatccattgtgcggatttcaatataatcatagccgtgcttttcgcacagttctaaatcctgtttcaggtttgaattctccagcgtagtcgcttcattaaagcaaagtttcatgtcagcctctcccatccgcgttttcgatatgaagggagtccggctgaagggcttttttgccccgctccgccgaactccatactcagcttatgccatacccagttcttcctttaatttcttaagcgtggtccggcttgattcatccgctctttcgccgacccaagcaaacacggcgttcgtcgcaattccgtcgaatttcatctctctcatctttctgaaaatcgtctcaaaatcgacctcgccttgcccgatgtccagatgctggtgaaccgttactttcgcatcaggcggattgacgatgtaacgcaggccgtgcgccgctttatgattaaaagtatctgcaaataaaacatgtgtgaggcggtcgccggcttcatcaaacatggtttcgatatcgcctttgccgtcatcatagaagaacgtatgcgcagtcgagtagacaagattgatccaatccttatcgagcgcgcggatcatatccatcgcacctttgtgcgtttcgataaaatcgtatggatgggcttgaagattgagtttaacgccttctttttcaaagacgggcagcagctcatccatggatttgatgaatttttcttcacttgtcaacggatcatactttgaaccgctgaattcactgttcatcaaatccacttcaagttcaaccgcaatttcgatcgcccgtttccagttgcgcacggcggcctggcggcggtcttcatcaggacccgcccagtggtaaagcggaagaagggaggacagcttcacacctgtatcctttaaaaggcgcttcaattgtttgatttttgctgaatcgactttcggatatttatagaaaggacaaaaatcctcgcgcggggacagttcgatatattcgtatccgagttccgccgttttatagaccatttcctctaatgttaaatcatcgcggtacatggatggatctaaggccagtttcattttttcactcccgatctattatttgttcacagtcgtaaatgattgatagaatgccggtttctcttgaagcgccactggctctttctgtccggattcctgagcttttacgcacgcgtctgttgtcaccgcggcaatataaccgtcccatgccgtcggaccgctgacttcgcctttcttccggatcgaatcaatgaagtcctgaatttccacatcatacgcagccgcaaatcggcgctgccagtccatcagaatatcggtgctgaattttccttcttttctcaagctgatgcttgacggttccggaagcttaatgacgccgtcttccccgacgatttcacattgaatgtcatagccgtatttacagttcacatagatttctgcattgatgacgatgccgccttttgtttcgatgatgaccatctgcggatctttcagatgcggcagcgcattttttgatttcttcggatagatgacttgtacggattcatagtcgtcattgacaagccagtggaggacatcaatttcatgaacgagcgtatcgacgacggccatgtccgttgaataattcgatgcgactgtcgggttgcggtgcgcacagtgaatcatcagcggctcgccgaccgcacggttgtcgatcgcttctttcagctgaacgtaaccgctgtcatatctgcgcatgaaacctacctgcaccaatcgttttcccgtcttcatttcttcctcgacaatgcgcatacagccttctgccgttgtcgcaagcggcttttcacaaaacacgtgcttgccgtgctgaatcgctttcaacacgctggattcgtgagccgggccccagcttgtcactaagacggcatccacattttcagcagcgagaaggctgtcgtcatcaggataaaccgaggcgttcaaattgaaatgctgaacggtctgctgcgcggcctcctgattcacatctgtgacagcggtaatttccgcgcccgacagcttatttgtgatgcggttgatgtgctcttttccgatagcaccggttccgataacacctatacgtaaattcattgatcgccactccttctgataatcaaataatggttctcgtctttcttttctctctgccgtcctgaggagcaccgtacagttcctcctgtatctgttcaagcgacttgccggacgtattcggtgcgaagacaagcccgatgatcatactggccgtcacacatatgagcagaataccggccataaaaccgatgccgaattgtgacatgatgaccggcacaaataaactccaaatgccgattgaaatacggacgagaaagaacatgagcccttgtgctgacgctctgtgttctgtcgggaacagctcgcttgcccacagctggtagttcgcctgctggccggctccgttattgatgccgatcgctaaaacaaacaaaagcagcatcgggagtccctgaaacggcagcaaaaacagcgaccagccgacaacagccataaaggcgcagattccgaacaccgttttccgatattgatctgcaaaaggcatgaagatacaggcgacgccgagcccggtgaagataaacagggccatctgcagaatgttggccgtatttgcggatacgccgccgacctgctggtagatgtacggcatgaagaatcccatgacgcccgcggcgagattccatacgagaaacacacccattaaaaacaaaatgttcttgaaaaatttcggctgaagcaagtcaaaataagatgtttttttcacggcggcaggccgctcttcactgtttttccaggcatccgactcaggtaaacgctttcttatcacatatgtgatcagggcgatcaccaatagatgcgcaaagacaattttatttcctaaaagcccgaggtcaccgaccaaaacggataacagcagaaccacaacggctccggcggcccacgccacctgcgccactccgcaatgcctcgcccggtttttctcgggggcgttttccgcgataatggtccatgaagccgtaatatccgcgcctacagaaatcccgataatcatgtatccgcataacagcatgggaaagttgaatccaaacaaaaccaaacaaattcctaaagcgtagacgagcatactgtttgtgtatacagcttttcggccgaccttatcagccaaatacccgccgagcagcgctccgatggccgctgatatcgcgtttgcgctgaaggcgccgagcaatccgatctgactgtcggacagcttcaagtagctgacccacatagataaacccgctgatcctgccacgatggaacctgcatcaatgtaatttgctaatgctgcggcgatggtccgtttgctgaaagctgattccgccttggcactattcatataagtcccctctaatttgcaggatcaagcagttcactgtcgatgtactttctcgcaatcagcgcgtactcaagcggattggcgactgccgggtcttgttcggcttcaatgacgatccagcctgaataatcatgacggacgagcgtttggtacacttcggtaaaatcgatgcatccgtctccgggcaccgtaaaaatgccctgtaaaaacgactgcctgaatgacttgccttcctgtctgcaccgctccataatgtcaaaccgcgcgtccttgaaatgaacgtgtctgatccgatccatatgcttgttgagaatcgtcatatagtctccgtctgagatataggcatggccggtatcataaagtaaatggacataccgcgggtccgttccatccatcagccggtcaacttcttccgccgtctggacgcctgtgccgagatgatgatgaaacgtgagctccagcccgtattcgtcagcgattttcccgagacggttcaagccttggcacagtgtatcccattcttcatttgagaagtgcggttttttcttaaatacatcaatatccaagccctggacactgtacgtctgttcagaaacgatggcggcatccgctccgactttctgcaaataatcacagtgttctgtaaattgttcagccgttttttcaataccgtcttgaatgataaagctgctgaaccatttccccgcaatccgcaagttccggagagccagctccttattgaggacggagggttcagggaaaaaccctcccacttccgtaccttgaaaaccggcgacaacaatatcgcttaacaaatgctgcagcgtattcccggctccgatctccggcatatcgtcattgcgccacccaatgggagcgatgccccacaaaatattttgtttgcccatcgtgatgcctcccctctagtactgcttcgcagacttcagcttcatctctttcgcttcgtatgcccgctgaacgctttcctgctcagacacttccgccacgccgacatgccaccagctgtcatagccgtccgtcatcgttttcggcagaaccttcatttcaattaaagtggatacctcttgcgttttcgcatcttcaagcgccgctttcagttcttcaaccgtattggctctgtatgttttagcgccgtagccctctgccaccttcgcgtaatcaacgtttaaaatctgattgtcctctgtgcggaactcgcagaaataactgccgctcccgtgatccatctgcaggttgttgatacagccgaacccggagttgtcaaagagcaggacattgatttttttgttatattgaagcgcggtaatcagctctgagtgcagcatcagaaagcttccgtcgccgacgagtgaatagacttctttgtcgggatgagccagcttgaggccgagcgtgcccgatacttcatatcccatgcaggaatagccgtactccagatggtacgtattcgggacgttggaatgccacagccgctgcagatcgcccggaagagatcccgccgaactgatgacgacgctgtcttcaggaatcgtgtcgttgatggtcaacagcgccgttgtttgcggcagctcagtctcgagcgcgtcggcatactcgtttaacacgtcctgtgagaaatggtttttaatttccggcttgaacgcgtcacgtgtaaaagtgaccttgccgagccggtcccgttcagccagccattcatctttccagcctttaatcgccgtgccgaatgcacttttatatccgtctaataagccgtgcagcctgccgagcgtcactttcgcatcggctacgacctgaaacgcgtcaagtttgtatgcctgcatgcggctgacattgatattcaaaaattttgctttgtcaaaatcaaacgccgttttcgaggatgtcgcaaagtccgtgtaccgtgtgccgacaccgatgatcagatcagcctggcgggcggctttgtttgcggcaagtgtgcccgtgatgcccatgccgcccagattgttggcaaaatcggcttcaaccgttgacttgccggcctgcgtttcgacaagcggaatgccgtatgtttcagaaagcgcgattaattcctcacgcgcgccggagtacttcgcgccgccgcccactaaaatgacgggacggctgctctccttaattctctccgcggcgcctttcagctcacgctcgctcggctgcatccgatcaatgtaatgaacacgtttttcaaagaagctttcatcaaaatcaaatgcttctccctctacatcctgagaaatgcagatggtcgccgggcccgcttttgccggatctgtcatcacttcaaatgcccggattaagctgctcatcagctgctcggggcgggtgatgcggtcccaatagcgggacacgggctttaacgcatcgtttgtcgtgacggcggcgctgtattcctgctccacctgctgaagcaccgggtcaggctgcctcgtcgcaaaggtatcggccggaagcagcagcaccgggatatgattggccagcgccgtacccgcggcagccgtcaagttagcggcacccggaccgaccgatgtcgataccgcgtaaatttttcttctcagcatctgcttgctgtatgccatcgcggcatgcgccatgccttgttcgtttttgccttgatagactttcaggtgcccggcgtcctgctcgagcgcctgcccgatccccaacacatttccatggccgaaaatcgtgaagatgccctcaacgaacggctcttcttttccgtcaacatgaatgtactgccggttcaagaattgaatcagcgcttgtgctgtcgttaagcgaattgtcttacccacaaacgatcccaccttttatacgttctatttaccgttaagactgtgctgcgcttcaatcagttcgatgatttcaccggcagccggcattgcttctgaggagctgtgtttgctgacgacgatggaagcggaagcgctcccgtattttaacgacgtttcaatatcccggccgctgaccagtccgtagatgaaagctgacgcataggaatcacccgctccgaaggtcttcagcacctttgttttataggcgtgcgcccggaaaacttctcccgatctgctgtatgcgtatgatccgtcaacgccgtgcttaatgacgacaaggtcggcggagtgcgcaaacaaatggcggacggtttcatcgttatttccgccgctgcggttttccattacgtcaaattcgtcacgcgtaccgatgacgatatcggattgttccgccgccagcgtgtagtacacggctgtttcttctgccgattgccatgtatacggacggtagtcgagctcaaacacgacttttacgtcatgtttttttgcgatttgcaccgcttttaagacggcttcgcgcgacgggcttttcgcaagcgccgtacctgatacgagcagcattttcgcgtttgcgatgtagccttcattgacttcggacggctctagatacaaatccgccacgtcatcccggtacatcagaatgctgcactcttcaggactgagaatttccgtaaaagcgagcccggctttgcgtccttctctgtcaacggtcatttgtgacgtatcgacgcccttttcctgcatataagaaacgataaatctgccgtgctggtcatccgggattttgccgataaaaccggcttttaatccgagcttagcgctgccgatcgcaatatttgccggggagccgccgacatatttagaaaacgtcatcgtttcttccatcggccggttgtattccgccgcgttcaaatcaatacacgcgcgtccgatcgcgacaatatcaaactctttttcttcattaaacgtatatttcatcgttatctgccactcctcacttgtcagcgttccagaatccattcatgggccggatcattatgaaacttccattttcgtgtcggtcccgccattacattcatgtagtaagaggtatacccgtccggaacaccaaccgggtgatagcccgccggcacgatgacaacgttttcattttctgcggtcatcgtctcgtcaatcgagcggtcgtccgtgtacacacgctggaagacaaatccctgcggcgggtccgtttcatggtaataggtttcttctaaaaatgattcagccggcagattgtcttggtcatgtttatgaggcgggtagctcgaccagttgccgctgtccgtgtaaacttcaacaacgagaaggctgtttgccgatggatctgaatcggggagaatgttatgaacggttcgtttgtttgccagcttgccgcgatgttccacaccgttgtcttccgctttaatcagctttgtcggaagctggtgttcggacggagagtagcacagcgcgaccctcgccccgctgacggctgtgattccaaaagagcggtcattggacacataaacgctgtccgtcggttttctatcaaatacgctttcacgggtgccgatgctttcaaatgtctgatcataatcagtgacggtaacttttccagttaccgcaacgatgcagcactccgtctttttcaaatcttctgtataggttgagccgggagcgagatcaacgactttaaatccgacgtatttgaggtctgaattggctgaagtgacgtcatgtatgatggtcacgccttgagaaatttcatcggcctgcggtttgcgcagcaaatgactcatgtttattcctccttaatggatggtaaaagaaaacccggacggaatcacaaagccgtccgggccggctgtctgatcaattgaagtcaggagacgggtatcgtgccgtcacgacttttttacgtgtatagaagtcgacgctgtcttttccgtttgcgtgcaatgtgccgaagaaagaagacttccagcccgagaacgggaagaatgccatcggcgccgggacgccaaggttgatcccgagcattcccgcgtcaatattctcacggaagtagcggatcgcgttcgcatttgacgtgaacaggcaggcgccgttcgcaaattcagactggttggcgatgtcaaccgcttcttttaaatttttcacacgcatgaccgacagaacaggcgcaaagatctcatctttccagatcgtcatatccgtcgtcacgttgtcaaaaatcgtcggtccgacgaaatagccgtcttccgttacatgttcacggccgtcacaaagcagtttcgctccttcttcgatgcctttttcaatatagctgtgcgtgcggtttttgttgtcctcgcggatgaccgggcccaagaacacgccgtcatccagtccgtttccgatcttgatgtctgcggccttttcctgtaatttcgccataaactcatcggcgattccctcttcaaccgtcacaaccgcgcatgccatgcagcgctctcctgccgaaccgaatgccgcgccgataatgtttgtgaccgtatcttcaaggtgggcgtcatttaacacgatcgtatggtttttcgcgcccgttaacgcctgcacgcgtttcaaatgttcgctgccttttttgaaaacatactcgccgacaggttttgaaccgacgaatgagatggctttaatctccggatgctcaagaatgccgtttacgacgtcatgcgcgccgtgcacgacattgaagacgcccttcggcagaccggcctgttcaaacagctctgccagtttttccgttaacagcggcgtgcgctcagaaggcttcagaatgaaagtgtttcctaacgaaatcgccatcggaaacatccagcacgggaccatcatcgggaagttgaacggtgcgatgccgccgaccaccccgatcggatagcggtaattcgccgcctctacatctgtggcgatagaggcaagtgaatcgcccatcatgagtgacggcgcgcctgctgcgaattcgacgttttcaattccgcgtcccacttcaccgagtgcttctgtcgtgtttttaccgttttccaaagtgatcagacgggcaagctcttctttgttctgctggagaagctgctgatagttaaatagaattctcgcacggcgcggcactgccgtcttcgaccatgttttaaacgcttctgacgctgagcggacggcgtattccacatcctcccgcgtagaaatcggaacctggcacatcacttcttttgtagccggattgacaacgtcttcatattgatctgtcttactttcaacccattcaccattgatgtagtttttcagttttctgatctctgccattctcattgcctccttaaatagtaaacatcctgttcagctggataataacggatgaatatattcatcttttacatataaaagacatgaattaaacgcttacaaatgctaaaatgatggtgactcccaatcttttcatgtaaaagttggtcatgtgccggataaagcaaacggttacatctttcacttttgattttacaggttatattttggtcatttcttggttacattgtaagcccaacacaccttcaagtcaatctaaaaaatcaaaattttttcattatttttatcatactttttttaagcgggaaaacaggaacttggagaaccgtgtcgaatcgtacggtgggaaccctcttttttatcatttgttaagtaactattgattaactcttggtgtttattatatattttaattactttaagaattctagaaggagtttttttatgaaactgatgcggattcaggagatggaagaatacattctcaaacacggagccacttcgctggatgagctgtgcgaggtattcaacgtctctaaaaacacggtcagacgcgatattaataagcttgcggaaaaaggggtgatcaaaaaggtgtacggcggcgtgacgtcagcagaaaaatctgtgctcgtcccttttgagaaccgcaccattcaacatcaggatgaaaaaatcaaaatcgcccgctatgcgtcgcggtttatcgaggatcacgatcttgtatttattgattccggcacgacgaccaaatcgatgctggagacgcttgacccggataagaatgtaacggtgttgacgaacagccttgatattattaacgccgcttcatccatgaaaaatatcgacctgatcatcatcggcaataactacaaacggaagacaaggtcgtttgtcggcattgatgatccgggcacactcaataaatacaacattaacaaggcgttcatgtccgctaccgggacaacgatcacccacggcctgacgaattccgacttactggaatacgaggtgaaaaagaaaatttccgaaaaggcgaacgaagtgtatctgctcgcggatcattccaaattcggcaaatccacgcttttgacatacgcgccttttgaccggcttcacagcatcgtcacttctcagcagctcgatgaggaatatacgaagtattgccaagagcaccaaatcgacattcacttggcatagcgttatagttaatagagaacgctgccgtattttcccggcaggcgctatgatatccaattttttcagggggcgaaaacatgagcaaagtaacaatcggcaaaactgacctaaaggtatttccgatcggtttgggaacaaatgcggtcggcggacacaatctctatccgaatctgaatgaagaaacgggaaaagaattggtccgggaagcgattaaaagcggcgttaccatgttagataccgcctatatttacggtgtgggccgttctgaagaattgatcggcgaggtgctgaaagaatataaccgcgaggatgtcttcatcgccacaaaagccgctcatagaaaagaaggcaatgactttgttttcgacaactcaccggcctttttgaaacaatcggttgaagacagcctgaaacggctgcagacggattacatcgatttattctacatccatttcccggatgagcatacaccgaaggacgaagccgttcaagcattgaatgagctgaaaaaagaaggaaaaatccgttccatcggcgtatccaatttctctttggagcagctgaaagaagctaataaagacggcttagtcgacgtgattcaaggagaatacaacctgctgaaccgtgaggcggaaaagactttcttcccttatacgacagaacacggcatctcattcattccgtacttcccgctcgtatccggactgctggccggcaaatacgacgagaacacaaccttcccggaaggcgacctgcgcaatgatcaggcgcatttccaaggggagcagtttaaagaaaacatcaaaaaagtcaaccagctcaaaccgattgctgaaaagcacaatgccgatacggcgcatatcgtgcttgcctggtacttggcgagacctgaaatcgatatcctgattccgggcgccaaacgcgcggatcaattaaaagacaacatgaaagcagcctccattacgctatctgctgaagaaatcgcgtttattgacaagctgttttcctaagaaaaataacacgcctttttgaaagggcgtgtttttttatgtttatatttttctcttcggggaatgaaatagttatctaaataaactattatgcgttccaaaagatgaggaggatcatctgtgaagaaaaacaccaaaaaatacctgatttactttttcggagcattgggcgggctgctttacggctatgacaccggtgtgatttcaggggctttgttatttattaacaatgatattcctttaaacacgctgaccgagggattggtcgtcagcatgctgctgctcggtgcgattttcgggtccgccttaagcgggacatgctctgaccgatggggccggagaaaagtggttttcgtcctttcactcatttttattatcggcgcgcttgcctgtgcggcttcgcaaaccgtcaccatgctgattatctcccgtgtcatactcgggttagccgtcggaggctcaacggcgctggttcccgtttatctatctgagatggcgccgacaaaaatacgcggaacgctcggcacattgaataacttaatgattgtaaccggaattttactcgcatatattgtgaattacatattcaccccgtttgaagcttggcgctggatggtcggtctcgcggcagtaccggcggcgcttttattaatcggaatcgcgtttatgccggaatctccgagatggctcgtcaaacgcggccgtgagcaggaagccagacaagtcatggaaatgactcacgacaaagaggatatcgccgttgaattggcggaaatgaaacaaggagaagccgagaaaaaagaatctacgctcggcttgctgaaagcaaaatggatccgtcctatgctgctgatcgggatcggcctcgccatcttccagcaggcggtcggtatcaacacggtgatttactatgcgccgaccatctttacaaaggccggactcggcacttcggcgtccgttctcggcacgatgggcatcggtgtcttaaacgtcatcatgtgtatcaccgccatgatcttaattgaccggatcggccggaaaaaactgctgatgtggggaagtgtcggcattaccttgagcctggcgtcactatcagccattctccttctggccggcctgtcagcttcaacagcttggctgaccgtgctgtttctcggaatctatatcgtcttttatcaggcgacatggggtcccgtcgtatgggttctgatgccggagctgttcccgtcaaacgcacgcggagccgcaaccggatttacgacattgattctgtcggcaaccaacctgatcgtttcgctggtatttccgcttatgctgagcgcaatgggcatcggctgggtgttcggaatattctcagtcatctgccttacatccttcttctttgccgcttacatcgttcctgaaacgaagggcaaaagtttagaagaaatcgaaacgcacttgaaaaaacggttctccttaaagaagcgcagcaaacaaaatcaaattcttaaacagcgcacactgtaatcaaaaaaggaatcgccccgctgggcgattcctttttggcgtcataccatgactttgcagatatcattcgtaaactcgaccggatcatggatcggcagcccttcaatcagaagcgcctgattgtacagcaggtttgtgtataaagcaagcttttcccgatcttgtccgtgcgcgttctttaacgtctcaaacacttcgtgattcgggttgatttccagcactttttccgctttgacctgctggctgtcaggcatggcgtttaacactttctccatttcgatcgtcacttcgccgtctgtcgcaaagcagaccggatgagattttaagcgttttgaggctctgacattcttgactttatccgcaagaatctctttcatgctttcgaacaggtctttatattcgttttcttcggcttcagtctgcttatcatcttcgtcactgtcgatgcctaagtcggcgcttgagacggatttgaactctttttcctcgtagcttgtcagcattttgatcgcgaattcatcaatatcttccgtgaaatataaaatttcgtagcctttgtccgccaccatttcagtttgcggcagcttttcaatccgctcatatgaatcgccggacgcgtaatagatatatttttgatcctcaggcattctggacacatattcgtccagagtgacgagctttttctccttagatgaatagaagagaagcagatcttttaagacgtctttattcgcgccgaaatcattatagacgccgaatttcagctgtctgccgaaagattcatagaaagattcgtatttttcccttttgttcttcagcaagctcttcagctcggctttgatttttttattgatgtttttcgcaatcagcttcagctggcggtcgtgctgcagcatctctctggaaatgttcagcgacagatcctcagaatccaccatgccttttacaaagctgaaatgatccggaagcaggtcggcgcatttgttcatgatcagcacgccgttggaatacagctccaatcctttttcgaattccttcgtataatagtcaaacggcatgttttccggaataaacaaaatcgaattgtagcgcaccgctccatcgacgctgatatgcacgtgggtcagcggtttatcaaaaccgtaatgcttctcggcgtaaaaagcctcgtaatcctcatccgtcagctcgcttttgttttttctccagatcggaaccatgctgttgaccgtctgttcttcctgaacttcttcaaattcgttctcgctgccctctttcggcttgttgaccgtctcttccattttgatcgggtagcggataaaatcagagtactttttcacgatcgctttgatgcggtagttttctaaaaactcatcatagctttcatcttctgtgttttcttttattttcagggtgatttccgtaccgacggtttccttgtcacacggcgcgatcgtgtagccggcggccccttccgactcccatacatacgcctcgtcactgccgagcgccttacttttcaccgtgactttatcagccaccataaacgccgcataaaacccgacgccgaactggccgataatgtcatggccgtctttcgagtcattttcttgcttgaaagcgagtgaaccgcttttcgcaatcgtgccgagattctgttcaagctcgtcttttgtcatcccgataccggtatctgtgacggtaagcgttctcgcttctttgtccgccgtcacttttatatagtaattgtcttgatcaaacgttaatgaatcatcggttaacgccttgtaatagattttgtcaatcgcatcgctcgcgttggaaattaactcgcggagaaaaatttccttctgcgtgtaaatggagttaatcatcatgtccagcaatcgcttggattctgctttaaacttttttttccgcacttcagatctctcctttaattatgctttgatgttatgtaaaatcttttcagcatctatttatcatatacagtgacaattgtcaactaggattagcagatgcatatattgtaaatttaacatgttaatggattcatttcacccattttatcaataaaaaagagagaatgttgatcatcctctcctctctgcttctttccggcggccgaattccttcttcatccatatgtatgacgggtagaaaaacaaactaaataagataagagatcccaagtttcgcaaagactcatgcagaacatttcttacagtgagaggaaacgtgatgtcctgaaacagaatagagataacggtgtagatcacaaatcccataggaacaatggcataacaataaaacgctatctccttcttatgctgtatcttcaaaatatgtaaacctcccaatgatgtatatacataatattaacatatttaataggtaattagaaacaaacctccgtatgtttatccccctattcagcgggaacaggtatagaaaaaggaggaatcgcaatatgggaagattaacagacaaaaccgcaatcatcacaggggccgcgacaggcatcggacaagcgacggcacgggttttcgccgatgaaggcgcccgcgtgatctgcggtgacatcaatgaaagcgaactgaatgaaaccgtcagcgccatcagaaaaaacggcggagaagcagaagcctttcaccttgatgtatcagatgaagaaaacgtaaagtcttttgcagacggcattcagcaaaagtacggaacaattgatattctgtttaacaatgccggtgttgaccaagagggcggcaatgtccatgaatacccggtcgacctgtttgaccggatcatcgccgtcgatctgcgcggcacatttctgtgcagcaaatacctgattccgctcatgctcgaaaaaggaggctccatcatcaacacctcctccatgtccggccgggccgcagaccttgaccgttccggctataacgccgcaaaaggcggaatcacgaacctgacgagagcgatggccattgattacgccagaagcggaatccgcgtcaattccttatcgccgggtacaattgaaacgccgctcattgataaattggcaggcacgaaagaagacgaaatgggcgaggcgttccgtgaagccaacaaatggatcacgccgctcggccggctcggaaaaccggaagaaatggcggctgtcgcgctcttcctcgcttcagacgacagctcttacgtcacgggagaagacatcaccgcagacggcggcatcatggcatacacttggccggggaaaatgctgattgataagaagtggaaggaagagacggagtgacgatagataataaaaaaagccagtgtaaaaaaaacactggctgaacaagctgagggcgggttacttaaaccagcccttttcctttgatcgggtaatggcttcaattcgatttttcacttctagtttatccagaatcatcgaaacgtaattgcggactgtgccgcttttgatgctgagggcgtttgcgatttctttcgtgttttttccgtctgcgacaagctcgagcacctctttttcccgttcggtcagcgggttttcttcactataaatgtcctccattaattcaggtgcatagacgcgtctccctttcatgacgctgcggatggcgctgacgagctcatcgctcgggctgtccttgagcatgtacccgctgacgcctgcttttagcgcccgctgaaaatagccggagcgggcaaaggtcgtcaaaatgatgattttcacaccgctgtccttgagttcttctgccgcttcaagacctgatttcccgggcatttcgatatccatcagacagatgtcgggcgcatgtttttccacgaaatcgatggcatcctggccgcttgtgcctttgccgacaaccgtcatatcctcttctaaattcaacagcgaaccgagtgcgccgagcagcatttgctgatcctcggcaatgaagatgttgatcatctgctaccatccttttcttttgattttgaatcattcgggattctcatggtcagctttgttccggcggctgtatcgatggctaaactgccgtttgcgaattcaagacgttccctcattccaagcaggccgtgcccctttgaaaaaaagcggtcttctctgcattgaaagcttccgtcatcttctaccgtaatgacaacctctttccaaagctgctgaatggtgatgcggcatactttggcgccgctgtgtttcacgacattggtgacggcttctttaatgcacatgctgacgatgttttcgttcagcaaagagatatgtttgggcgcttctttttcttcatacacaaattcaattcctgccgcttcaagaatttgccgaacattgccgagctcatccttcaatcggatgcctttcatcgatgagacgatttgtctgacctcatttaaggaagtgcgggccgtctgctgcacgcttttcagctcagcgcgggcctgttcagggtccttatatatcagctttcgggcaaggtcgcttttcagtccgattaaggagagcttttgtccaagtgtatcgtgaaggtcccgggcgatgcgctgcctttcttccagcttcacaagatcggcaattcgctcatttgcatattctaatttctcctcaaggcgctcccgtgcctttctgcttcgaatgctgagcggaagcaggatggcactgatcagtgtaatgacgataaacggaatttgtgtcaaaaaccattcttttttcagaacaaggctgaagttgacggcaaccgccgcactgatgatatgaatgtaatataagatgtaaaatggaactttgtctcggatatggccgatgaagtaggcaataaagaaggcgaaataaatataactgaacagcatggctgagccggtcgaaatgccgatcagaagaagcgcccataagtaaagcggccagccttttgcaacaaatgcaaagcggtatgcgccaaagaaaacgagcgtgaaaatgatgccggccacgatgacgaaggtagaagagcttttaaaaataaaataaaaaggcaggatgaaaaaaatcgtccatatataaggagaaatcccgttcagtttttgaaatttaaaatacttcttcatctttgttccaccttctgctgcttgtgtctaccatcactttatcaaaacaccgccttcattgcaccctcacgcatgaagagaaggctctttctgataagagaaagagccgtgcgccgtatcaggcatttttctttaaaggttctttcggcaccggatggggcgccgatgttttccgcgcctcccggaaggtgacaaactgcttttcgtcctcatcccacagacggaatttcatggattcaagacttgttttaagcgtaatggtcggtacgttttttaaaggctcgtgtccctcatgagcggcttccagcttgtagttcggcaccttcggacttaagtggtggacatgatgatagccgatattgcccgtcagccattgcaaaagcttcggcagcttgtaaaaggagcttccttctaccgcggcctgcacataatcccaatgctcatcggcttcaaaataagaatcctcaaacgtgtgctgaacataaaagagccagacgccgattgaccccgaaataaggaaaatcggaccctgaacaagcaaaaagttttcccagccgagaagcaagcacgtcgcagcagccaataagacaatcgccgcgttcgtgaaataggtgttccagcgctccttgcggcgggcgccttttacattgaaacggtttttaatcagaaatacgtaaatcgggccgagaataaacataataaacggattgcgataaagtctgtagcgtatttttgtccaggctgacgcttcgttatattccttgacggtcatcatccaaatatcgccggtgccccgtttatctaagttgctgcttgtcgcatgatgaatggagtggcttcgctgccattgaaggaacggaaacagtgtcagcacacctgaaataaacccgaacagccggttcagcttcttttgtttgaaaaaggattggtggcagcagtcgtggaaaataataaagattcttgtcaaaaatcccgctgctataacagtacaggcgagggtcagaagataggagacattgaggctgaagtaagcaagaaaccaaagggcaaaaaacggcacaaacgtgttgaaaagctgaatgatactatgctttgtatcggcgccggaaaatgcggcaacctgcttttttaaagacgcttgtttttgagttgcggcgtgattgatcatgaatgtcatgtcccttctttttcattatgacctcaagtataacggggcgcccgacgcggttgtagtagcagccatcatgccccgaatatgacatttgtcatgtttggcggcagaatgctaatcaggcgtcatatggaaggtttctttcatatctgcacttctcaaagaaaacagcaaaaaagaacccggcctgttttcggccgagttctttttcatcatcctcacagcaaaatcacccgatacttcttcacatccaaaaactgcagaaactcccgggccagcatatccggcgcgtggtcttttccttcatgaagacgatattgaatcagaccgacgagcatggacgcgacatagtatgcatagagctttttgcccgcctgaatgtgcagaggctgatgaagataaaacgattgcagcgctctgaacatttccgggatgacgtcaggcactcctgaaccctctctcagaaaatgaacgagcggaaggccgccggacagcgccgaaaagagccggacgagcgcggcttccgcttcttccacggaacagtcggcaggatctccttttaccgtcaataatccgatcagatcccggcatgattgatggatgatcgttttcagcaatgcttctttgttggcgtaatggtcataaaaagtggcacggcggaggttgctttgacgggcaatatcggaaatcgtgatcgccgcgtactcttttgtttccgccattaagccgatcatggcttcttgcaaggcctgcctcgtccttgtcacccggcggtcggcgggctttttttcttcttgttccggcacccggcggccaaacagccagtaaaaccgtttttgagaaatcaaatcccacacctgtccgctgatttcttccggggatgccccgggctcctcattcagccagtacaacacaatggcatatgtgtataacgcgcggtaatgaatgtacatatcctgttcagtcggtgagaaatccgcattgaccggtgacagcagcacatcatgccggaacacatcttttaaaaaagcatgaacgtgaaaatacggcattttatgacggtccatcatcgtttgaaaaaacacccggtgccggtcaacaaaagacagtgtcggatgcactttttgccatccgccctgtaaatgaagcacatctttattcttcagcgaatcatacagcgcttcgctcagcccgtctttcatttcttcctctatatcctctaaaatcgcatatttatcttcgtaataaaggtacagtgtcccccggctcacgtgcgcccgttcggcgatgtccttcatggtcacacggcggatatcccgctctccaagcatggccaaaagcgcttgtttgatgtcatttgtcatagaatccggcataagagacactcctttcattagacagatcacggcaatttgtacggtaacgtatagatgcgtttacgctgtctttgccgcaaaaacacatcacattataataggccctgaagaaataaaaaagcaaccagaggaggaaaaccgatggatcagcatataaaagcagacatcaaacgcgtctttgcgcttcagaaaaaaaatcaaaaaacgctgcgtgcttcaacagccgggcagcgcagagaaaagcttcagcgctttttagatgccgtcaccgcacatgaagaagaaatcatcgaggcgatcagacgggacgtccgcaagccttatcatgaggtgaaaagagcggaaacgcagggaacgatcaaggcgattaaagataatatgaacaatctcgacacctggatggcgccgaaacgcgtcggctcatccgtcagccccgacgctgacggcgtattaatgtacgagccaaaaggccttaccttaattctcggcccatggaattatccgtttatgctgacgatggctccgcttgcggctgccattgcggcgggaaacagcgcgattgtgaagctgtccgattttacgatggagacgagccatatcgccgcgacagttattcgcgaggcatttcacgaagaagaagtcgccatttttgaaggtgaggtcgatgtcgcgacagaactgctcgaccagccgtttgaccacattttcttcaccggaagcacgaatgtcggtaaaatcgtcatgacggcagcggcgaagcatttgtcgtccgtcacgcttgagcttggcggaaagagcccgacgatcatcgacagcggctatgatttgatggacgcggcgaaaaaaatcgccgtcggcaaatttgtcaatgcggggcaaacatgtatcgcccctgactatctccttatgaaggaagatgtacaggacacctttacagatctcctgcagaccattgtcaatgcaggttttatggaggatgatcatacggttgaccgcaacaaattcacgcagattgtcaatgaccgcaactttaaccgtgtcaaagccctgtatgatgatgccattgaaaaaggggcaaaaacggcgttcggcggcgtattcgatgctcatgaccgcacgatttctccgaccgtgctgacaaacgtcacgcctgatatgaagatcatgcaggaagaaatcttcgcaccgattctgccgattatgaattacgaagatatcagtgaagccgttgattacatcactgaacgggacaagccgcttgccttgtatgtattcagccataatcaggagctgatcgattatgttctgcagcatacgacgtccggcaatgcttctgtcaatgatgtcgtcgttcatttcactgacgtcaaccttccgttcggcggtgtcaatacgagcgggatcggttcatatcacggtgtgtacggttttaaagaattctctcatgaaaaaggcgtattcattcaagcctctaaataaaaaaaagaatccgcgtgcgcggattcttttttattatttttttgccccgaatgcgagcagtttcgtataagtgccgacgtagagcgtgccgtcttcagccagaaccggggaggaaatgacattgctgtctgtttgatagcgccatttttcattcccctcagcgtcaaccgcatagacgtttttatcgtcagaaccgaagtacacattgccgtccgcatcaatcagcggcgccgttctcacaggcccgtccgtatagaaagaccagttcatattaccggttttgctgatggaaaacagctcgccgcttcccgaaccgatatacacattgccgttatggtcgatcgctaatgaagagctggagaaaccgtttaacgggaacgtccactttacagcacccgttgatgtataggcgtataagttgccgtcctggtttccggcgtaaacggtgccgtctctatcaataaccggataacctttaaacccgttggacgtcgtttttgaccatttcacttggcccgttccggaattgatcgcgtaaaagatattattgtacgttgccgtatacagagtgccgtttgatgctaacacgggagcggagccgaccacgccgtttgttttaaatttccacttttgcgtccatgtcgatggcgacgtcggtttaatcgcatagatatagttatccagcgtcgacacatacagcgtgccgtcagagccgatagccgcatcggaactcggcgctccgctcagcggaaccgatgttaaaatgtttccggtttctttgtcgatgaaatacagttttttatcgtgagaaggaagataaatgacaccgtttgttccgagcaccggagtcagcgtataggtcgtcccgaggttttccgtcacccatttcacagtaccgtccggatgatacgccgtcagcttcccgtcttttgattgaataaatactgtgccgtccccgtcaaccgcggctcccgcaccgttttgaggggtggccggaacattcttttcccattttaacgcgccatcggcagtgcttgtaaaccggctttcccttgaccagttgaacatcgtcggagacatcgcctgcgcgtcataccgtcccgccaagaaaccggatgccgcatgattttgtttaaataccgtttccgcggcttgagcagccgccggatgcagccattttgcccccggcagatcagaaaccgcccccacagataaagccgcagcaaccgcagcgccggccgccaatgttttcattcgcaatgaagctgtcttttttttcaatgtcagttcctcccgtttctattaaaaactgctataccgctttcatcataccataatcatcctatgaaatatttgtattttcggtagatttatagaacaaatgtcacatagcctgctgatgcttcggggatgatcgaaacgcggcaatataccacaccacattgacgatgaaagccgcgcctgaccaaacgaaaagaccgtaataaagagacagctcctgccctaaggaaattgcggtcaataacgccaccaacaagacagccgcgcaaatgataagcccgatcccgcaaaaaacagccatgatgattttcatgccacgaacaccgagaatatacataatgagcgggaccgcatatataacaaggatctgaccgacggcggcccacatgcccgcggaattaaaacgattcgcgttcggccccgtttctgcaagcggagaaagcgagacgaggaccggcaataaacaaaacatcagagcggaaagcaaggtcaccgcaaccgcaccttttttcttttgattcatgtgaatatcctcctgacaataacccggcttttttaccggtaatctgataatatgttatattttagcacgatatttacttaatttgagaatgttttgtcaaaaacgaatttacaaatccagaaaaatagatataataaacgttatggaaccgatattgattcataaagcgttatctaacaaaacacgaagtgatattatgacgtggcttaaacacccggaagaccattttgatgaaagaccttatcttgatcagggactcagtttccgcaccggaatttgcgtcggtgatattcaggcaaagtcagggcttgcgcagtccgtcatctccagctacctgctgacgatgcaaaaagccggcctgctggaatccgaacgaatcggaaagtggacctattacagaagaaatgaaaaacaaattaaagcctttgctgactatgtccagcaccagctataaccatgaaaggagggatttttttgttctaacatatctatttttctatatatgtagttaaataaaaggaggcatacataacaatgaaaaaaagcagctccatcttcattctatttttggcactaggggttttcgggattatcacgaccgagatgggcattatcggcgttcttccgcaagtggcggacagatttcatatttctgcttcaaaagcggggtggcttgtcagtattttcgcgttcatcgtcgctgtgtcgggaccgtttttgaccttgcttgcttcaggtataaaccggaaatacattctgcttttagcggtgctgatgtttgccgtttcaaatgcggtctacgcgtatacggcgcatttcagtgtcatgctggcgtttcggatcattccggctttatgccacccggtgttcttttctgtagcgcttgcggccgcggcccggcttgtccccgccggccaatccggaaaagccgtaacgaaagtcttttcaggcatcaccgccggctttgcgttcggcgtgcctttcacgtcttatctggcggatcgtctctctcttgaagccgccttcttattcggcgctatcatcagtctcatcgcgttcacgggcattcttctctttttgccatccatgccggtcacagaaaaaatgtctttcagaagccagctcggcattcttcgcaaaccggctttgtggctcaatatcgctgccgtcacctgtctctttgcggccatgttttctgtctacagctattttgcggagtacctcgggcgggtgtcccatatgatcggcacatgggtcagcttcatgctgatgagtttcggggtgattatgatagccgggaatttcgtcttcggtgctttgttatataaaaatatgaaaaagaccgtcatcctgtttccgcttctttatacagccgcctacttgctcatatacgggtttgggacgtctttcgcgccgatggccgtcctcgtcttcgtatggggcgccgttcattccggcggtctcattgtcagccagacatggcttactgcggaagcaaaggaggcgcccgaattcggcaacagcctgtttgtctccttttccaacctcggcatcaccatcggaacggcggcgggcggctggtttatttcacatttgggaatccatcagctgatgtggtgcggcatcatgtttgcccttctggctttcgggctgatcatgggacgcttggcatggggaaagaggctgctcgcagaagcttaagctccattgcaaaatccggaatgattacgtataatattccagattaaagcaagggagagaaaaagatacatggaaagaccggcaggattttggattcggtttctggcttacgtcattgatcaaatcatcataggaattccgatttttatcattcaatttatggtctcttttttatttgcggcaggcgttgcggcggctgaccccttcatgaccgaaaatcagtttaacatctcttttctggtgttcggcgtcattccgattcttgtgagctctattgtgatcagcatcttatatttcagcctgctcacagcctcaaagatgcaggggaccctgggaaaagcattgctcggccttaaggtcgtcaatgaagatggcggacgcatttccatcggccaggccttcggacgcgctttcgcctatatcatatccaagctcattctttatatcggattcatcatgggtgccttcggagagaaaaaaacgctgcacgacatcatgtgcagcacccgggttgtttataaataatgtccccaagtccgggccttttgagcccgggcttttttatgacggctgtgcccgcctgatgtcaatgccgccttctccgtcagcctcaatgcggatcgtcccgttcacaatgacagacagcggatggaactccgcatgctgatcagaaaaaatccagcggcggccgctcggccctaaaagcaaaaacgccccatcattgtaatcacccataaaatgaaacccgttttcactaagaggcgcatgctttctcaccggaatgccgagacgctgcagctccttccccgtcgataccacctcggcagccgtcagattcacctcaccgatattcagaacggactcaatcgaaaaacgttccgcgcttggcggcgatgtgtctctcgcgatgaattccgccagattgttggacggatctttaaaataaaaggaacgcgcctgaatatgggagaaatacacctcatcctccccatcttccgtttgaaaaacgactttatcctttatccacgccttcgcctcatcaaaacgattattcggaatgttaaacgcaaaatgatacgtcggttgagagtgagaatcggcgcgcctgaattccaactcactttctcccgccttgatggtaaacgaatccccggactcatcaattaaaggaaaacctaacacccgttcatagaagtgtttcgtctcctccaacgcacaactgtacaaagtaatgtgatttatttgcatgatcataccccctttggtttatactgccatatagaggggttgattcctactgtttcgattcaccaattgagaatccccctttcgcccggcgctaaacatgacaaacagcgccaaaccgcttataccaggcgttttttaacgtctaaagcaaaaaaagcagaaaataataccccatatagcttgacaaaaaataaatgttatttaataatctatatataattagaattattattgaaagataaagtgaatgctttgtctttttaatatatttcaaatcacatttcaggaggaagatattatgtctttaatcggaaaagaagtactgccattcgaagcaaaagctttcaaaaacggtgaattcatcgatgtaacaaacgaagatttgaaaggtcaatggagcgttttctgcttctacccagcggatttctctttcgtttgcccgactgaacttgaagatcttcaaggacaatacgctgcactgaaagaattaggtgttgaagtatactctgtttctacagatactcacttcgtacacaaaggctggcatgacagctctgaaaaaatcggcaaaatcacttacgcaatgatcggtgacccatctcaaacgatctcccgcaacttcgacgttcttgacgaagaaactggtcttgctgaccgcggaacattcatcatcgatcctgatggcgttatccaaacagttgaaatcaatgcaggcggtatcggccgtgacgcaagcaacctagtaaacaaagtaaaagcagctcaatacgttcgtcaaaacccaggtgaagtctgcccggctaaatgggaagaaggcggcgaaacacttacacctagccttgatttggtaggtaaaatctaaggagtgcattccattggtacttgatgcaaatatcaaagcacaattaaatcaatacatgcagctaattgagaacgacattgttctcaaagtaagcgccggtgacgatgacacttctaaggacatgctggctctcgttgacgaactggcttccatgtcatctaaaatttcagttgaaaaaactgaattaaacagaacaccgagcttcagcgttaatcgtaccggagaagacacaggcgttacattcgccggtgttcctctcggccacgaatttacatcattagtgctggcattgcttcaagtcagcggcagagcgcctaaggctgatcaaaaggtcattgaccagattaagaacatcagcggagaataccgctttgagtcttatatcagcctgacgtgccacaattgccctgatgtcgtccaagcattaaacatgatgagtgtgctcaacccgaatatcacacatacaatgattgacggcgcggcattcaaagaagaagtagaaagcaaaaacatcatggctgttccgactgttttcttaaacggtgaatctttcggcagcggccgtatgaccatcgaagagattctcgcgaaaatgggcagcggcgcagatgcgtctgagtttgccgacaaagagccgtttgacgttcttgttgtcggcggcggacctgccggcgcaagcgcggcgatctacacggcgcgtaaaggcatccgcaccggtgtcgtcgctgaacgcttcggcggccaggtactcgacaccatgagcatcgaaaacttcatcagcgtcaaagcgactgaaggaccgaagctcgctgcaagccttgaagagcacgtgaaagattatgatattgacgtcatgaaccttcagcgcgcgaaacgccttgagaaaaaagacctcttcgaacttgaacttgaaaacggcgctgtactgaaaagtaaaacagtgatcctttcaacaggtgcccgctggcgcaatgtcaacgtacctggtgagcaagagttcaaaaacaaaggtgttgcatactgcccgcactgtgacggaccattatttgaaggcaaagacgtagccgttatcggcggcggaaactccggaatcgaagcggcgattgaccttgcaggtatcgtcaatcacgtgactgtgctggagttcgcgcctgaactgaaagcagacgaagtcctgcaaaaacgtctttacagcctgccgaacgtcactgtgcacaaaaatgcacaaacgaaagaaatcacaggcgaccaaaacgtaaacggcattacgttcgttgaccgtgaaacaggcgaagaaaaacacgttgaactccaaggtgtattcgtccaaatcggtctcgtgcctaatacagaatggttagacgaaaccgtcgaacgcaaccgcatcggcgaaatcatcgtcgataagagcggcgcgacaagcgttcccggcctatttgccgcaggggactgcacagacggcccgtacaaccaaatcattatctccatgggatcaggtgcaactgccgctttaggcgcatttgattatttgatccggaattaatgtaaaaagcgctaccctgcttacacggcaggatagcgctttttttatattaaaacggcatactgcatggcagtacaccgtctgaagtaattcaatctgtctttctccctctcgcccgatagataagaaacaatccaataaaccacagcggcgtcagcagcaaagccgggcgcgtcgcatccgcaaacagcataatcaccagaatgaaggcaaacagcgccagcacggcgtaattgataaacggcgcaaacggcgccttgaaagacgagcttgcgtgtaagtccggacgggttttcctgtatctgatatgacagacaagaatcacgccccacacccaaatgaaacagatcgcgctgatggttgtcacgatgccaaaggccgcttccggtatcaatttgcttaaaagagcgcccgctgacagcacaataaccgatatccataacgcgcggctcggcacatgatttttattcagcttcgcaaaacttgccggcgcctgtttcgttttgcttaagttatacagaatccggcttgttgaaaacatcccgctgttacaagcagaagcggcagacgttaatacgacaaaattaatgattcccgcggctaacggaatgccgaccagactgaaggtctttacaaaaggactttccgttgcattcagctgcatccacgggttaatacataaaagaatgatcaatgccccgacgtagaaaaataaaatccgcaatggaattttattgatcgcggacggaatattttttttcggatttgacgtttccgccgccgacacacccactaattccacaccgacataggcgaagatcaccatctgaaatgaaagcaaaaagcctgaaaatccgttcgggaacaagccgccgtgctcccacagattcgccgctgaaaccgttccggtatgcgttttgaacccaatcaccagcagaaccaccccgatgacaattaacgcgagaatcgtgactaccttaattaaggcgaaccaaaactccaattctccaaaaatcttaaccgttaacagattaagccctaataaaatgagcaaacagataagtgccggaatccactgcggaatatcaaaccaatatttcacatacacaccgacggcgatcacatccgccatagccgtcataatccagcaaaaccaataagtccagccggtgacaaacgctgcacgcggccctaaatacgcctcggctatatccgttaatgattggtaccccgctttagataacagcagttctcccagcgccctcatgacgaaaaaaagcgcaatacctacaataaaatacgcaaagatgatagaaggacccgccagctgaatcgccttaccggaccctaaaaacaatccggtaccgatcgtgccgccaatagcgatcagctgcacgtgccgattcgataagtccctctttagctctcgctgctccacatctgactcctccttacctctctagtgaacgacgagcaaaaaaagccaataaaaaaagagattggatgccctccaatctcatggtcataagaatatcaaattatatttgcgccgctgacaatcaacagcatgacaaatacatattcggtactcttctgtccttttgcctgagattgtgaacccttcggcgccgcggaaaacccgcggtctctccagaagccgctcctgctgtagtgcgacccacagcaatcatagcctgctacgtattgagtttccgatagaaataactatcagctaactttttattttaatggaagttgaatgcattgtcaacaggggtatacgctcacagcgttatcccggtccaatttttgatgcctgaagcgccgtatcttccgttttcattgtctcaaaaaggcgttatgcggtactatcatataaggtctaatcatttaaacattatgtcatactttaaattcactttatcatacaattgctcgtaaataaaaaggggatggacgagattggaaaccaaatatttagatctgctcgcacaaaaatacgattgtgaagaaaaagtggtcacggaaatcattaatctgaaagcgatactgaacctgccgaaaggaaccgagcatttcgtcagtgatctgcacggggagtaccaggcattccagcacgtgctgcggaacggttcaggaagagtaaaagagaagatccgcgatattttcaacggcgtcatttacgatagagaaattgatgaattggcggctttggtctattacccggaagacaaactgaagctgatcaaacatggctttgatacgaaagaggcattaaacgagtggtataaagaaacgattcatcggatgattaagctcgtttcttattgttcttccaagtacacccgatccaaattgcgcaaagcactgcccgcccaatttgcttatatttccgaagagctgctgtacaaaacagaacaagccgccaacaaggaacaatactactccgaaatcatagaacagatcattgcgctcggccaggccgataagctgatcaccggtcttgcctacagcacgcagcgattggtggtcgaccatctgcatgtggtcggcgatatttacgaccgcggaccgcagccggataaaatcatggaagaactgatcaactatcattcagtggatattcaatgggggaatcatgatgttctctggataggcgcttattccggctcaaaagtatgcctggcaaatattatccgcatctgtgcccgctatgacaatctggatattattgaagacgtttacggcatcaatctgagaccgctattgaaccttgccgaaaaatattacgatgataacccgtctttccgcccgaaagcggacgaaaacagaccggaagatgagattaaacaaatcacaaaaattcatcaggcgatcgcgatgatccaattcaagcttgagagcccgattattaagagacggccgaactttaatatggaagaacggctgttactggaaaagatcgattatgaccgcaatgaaatcacgctgaacggaaaaacgtatcaactggaaaacacctgctttgcgacggtgaatcccaaacagcctgacgagctgctagaagaagaagcagaagtcatggacaagctgctgttttctgtccagcactccgaaaagctgggccgccatatgaattttatgatgaaaaaaggcagcctgtatctgaaatataacggcaacctgttgattcacggctgtattcccgtcgatgaaaacggcagcatggaaacgatgatgatagaggataaagcttatgcgggccgtgagctgctcgatgtatttgaacggttcttacgggaagcgtttgcccatccggaagaaaccgatgatctggcgacagatatgacgtggtacttatggacaggcgaatactcctccctcttcggaaaacgggccatgacaacctttgagcggtatttcattaaagagaaggaaacgcataaagaaaagaaaaacccgtattactatttgcgtgaagacgaggcaacctgccgaaacatcctgaaggaattcggcctcaatccggatcacggccatatcatcaacggccatacaccggtaaaagaaatcgaaggcgaagatccgatcaaggcaaacggaaaaatgatcgtcatcgacggcggcttctccaaagcctaccaatccacaacaggcatcgccggctacacgctcttatacaactcatacggtatgcagctcgtcgcccataaacactttaactccaaggccgaagtgctgagcaccggaaccgacgtcttaacagtgaaacgattagtcgacaaagagctggagcggaagaaagtaaaagaaacaaacgtcggtgaagaactgatgaaagaagtggcgattttggagaaactgcgggagtatcggtatatgaagtgaagaatatggagttcagagatgattctctgggctcttttttttacggttacggactaatgagtccctttccctatacgtaaaacggatttaaccgcttcttcaatctcccgataaccggtacatctgcaaatattggactccagccaatttttaatcgtgtcatcacttgcattcggctcagtattcactaaagcatgacaattcatgagaaaacccggtgtgcaataaccgcattgaaacgcgaatttttcaataaaggccttttgaatcggcgtattgatcagtccttcaattgtcgtaatatcctttccttccccttctgccgcaagcattaagcaagatttcatcggcaccccgtccgttaataccgtacaggcgccgcaatccccatttaagcagcccggctttgcaccagttaatccgagacgaagacgaagagcaaataacaaagtatcagccggtctgaccgtcatctgtctttcctcgccatttactttcaacgtaataggatcagacatttggacctccttctaattcccgtaaggcatctaaaattgtatgttgcaagacaaatattcggtattcacttgagccttccgcatcatcaagaacgggtttgggtacatactgtaaagacctgcgcgctctatcttctaatgaatagcttttatcgttaagcacagcctccatttcagcagaacgaaacggaaatggacatacgccgctgaaagccattctgatctcatcatcttttttcagcgcacagactgtcaccaatggatatccgacattccactgctgtcttcttttgatactgacaaatggcaagtcaacatacgctcgatcgacaacgatatgaaataaaaaatcacctttttgcaattgtatttccttgttaaatactttatttataggatggtaatgaatccccgctctccctgcaatccctagcaaactatcagaaatcagcaacggcagcacggcctcacggtagtagatgcccccgcaaatgtttccgcccaggctgatcttatttcgagtcgtccgatcggctatttcacttactgttttacttaatagcggaaatggattttcttcctccagtttcgttaatgacacacccgctccgatcaccagttcatgttcataaaagcggatggtttgaaatcccggaagcgcgttcatgtctatcaccgcatccgtatagatgatattcagccttcctaacgtgataatttccgtgccgccggaataatacattggtgttttcttttcggccgcaagcgagtgaaatagattgattgtttcttgaatggtcttcggtttaaaataatcaaaatcaaacggtatcatctttccacccctcttgcgtcctccataattgttcgggaatgagaggaagttgattcaattggacacctaaagcggcggaaaggcaatttcccaatgcggccggcatccccagcagtccgtgttccccgccgccgcgcgctccataaggcgcaatcacatgcggggtttcaacaaattcaatgatatattcaggctgctctccatagtgaagggggcggtatgttctaagctgaggatttaatactctgccatatgaatcaaatacaaaggtttctcttcctccgaatgcgattcccatactcatcccccccatcacttgacccttgcagctttttcattcaatactgttcctatatccacaacagaataggcttttgtaattcggtacgtataatcccgtttatccaactcaacttcaatcccctgagcacctacagcccattcgggtcccggctttcctcttcccgtttcccggtctaaattcgtcatccgggttaatgtgtaattgccgctcgcaatgatttggccgccaatggtatttccattcggaaacgtatatccgtaagcaatgtcttttatgtcaacatgtacagaaggatgatctataaaataaacctttccgtcggccacttccaattcctcgacaggaactcgcaacacacatgatgccgcgtccttcagctttcgaatggcttcctccgctgcattcagtacggcttttccggccattaacgtccctctgctccccacggttttccaatgctcgggtgttgtttgtgtatctacaagcatttttacgtgaattttgcttatatccattttcattcgttccgctaagatttgggctaacactgtttttgtccctgtcccaatctccactatccctgacatcaaattaatgcttccatcaggattaaaggttaaaatcactccggacgttgcatttgtatcaaatgttgaggttttccaaatacagctgatccccttcgcccgtatcttccggccgtcgatttcaattcgctgtccctcgtcccaattcattaattccttcaatctttcaatacatttcggtacatttccgaccgtgcttgaattgagaagaacttgagtcggtgtggtgtcaccggggcgaatggcatttttatagcgaagttctaacgggtccatgttcagcttttccgccaatacatccatcgtccgctcaaaagcaaataacacttcagcatggctgtagcctctgaatgcacttggatatggatgattcgtatacatacaatatgaatcacacgatatatggtcgatagcgtacggacccgtacaatcaaccaccgcagcccggctgatgtccactcctttatcagagtatgctccgccatcaaataaaagctgaatgtccgccgcctttaaaattccatcctttgtggcccctaatttgacaatggcatccaatcctacatgaacgggagatgtgatcatatcctcttctctcgtattaaacaatttgacgggccggcctccgactgcttttgatgccaaataggcaatcacctctaactgaacggctgcttttcccccgtacgccccgcctactaaaggcgttttgacgataacctttccgggttcaattccaaaataccactgcattaattttttaatggcaaaaggggcttgagaggatgtggtaatgataatctcctcatccgcccgaatttcagcgatcgagcatcttgtctccatcgcagcgtgatcagaagggttaaaggaaatctggaattctgctgtcacatcactttccctaaatccgtcttcaatatttccttttctaaccttatccacgtttgcgatatttgtcttcggaaccgggaatacaccttttgtcttctcatagcggtccgcatgttcatgaacgagcggcgcatccttttgaaaggcctcacggggggaattgacgacgggaagaggtttataggatactttgatggcatccgcggcccttttagctgtaatcggattttccgcaacaacaacagcaaccggctcaccatggtatctgacccttttataagcaatcggcgatctgtctttaatttcttcacctgcaagcggaaaaggttcatcccccaatatcgctctcacgccgggaatcttccaagcttctgaaaagtccatcgacacaatatcggcatgagcatatggactggtcagcatttttgcgtgcaacgtccctgtttcttgaaaatcatccgtatatttcgctttacccgtcactttttcaagggcctctttccgaatgacactcttcccgatatactccaactcattcactccccgaatttattcagcagcagcgtataatcttcaactgtatcgacgtcataaaaaagcaaagggtcttgaaagctgatcatttttcccatattgatcatactttcacggatcacatgccgggcgccctgatctccctttaactgatgcaataccgggaaacattgatttgagaataaaatgggggcataggaagatgctgattttcagcggcgataaatgaataacggcgctctttttgataggaatcaattaacgtattgatgatatctgcggtgacaaacggctgatctgcaaggagaatgataacggcgtcagcctcgtacgctgccgctttttgcaaaccgcattgtatagaatggccttggcccttacccgcttgctcacattctgcctggctccacttatttgacatgggatctaaaaagaaaaaatccgaaagccaatgcagtgaatctccctttctcgtaataacaaaaatatgatctaattcagataacaaggcatttttaagagccatacttccgagggaaacgccattgagaaataaacttcgcttatccgttcccatgcgtctgcttgtaccggctgccaggtaaatgcctgctgttttcataggcgagacctttgttttcgcattttttgaatcatctcgccgacaatgcttacagcaatctcttcagggccttgtgccccgatgggaagtccgataggggaatgtatatcttccggaatctcacccccgcctaaaagccgctccgtacgccttctggggcctaatacgcctttataaaacacattctcgttttttaatgtatgtaaaatgatctgatctttttgaaagctgtgcgtcataatgacaacaaaatccctttttgtcatgctcaggcctttcatgacttcttcaggcgctcccgttatcaaatggccggcttcaggaaaatggccgtgatgacataaggcgggacgccagtcaatcaccgtcacatgaaagcccgcacgagccgccaacgaaactaacggcctcgcatcttctcctgctccgaagacatataaacaaggttttggcaccatctgatggataaaaaacaaatcagatgtatgttcatcccttttgattcccttctccgtctgtctcagtttttgaatacggccttgttccatcacatccccggttccaaacacgctgccgtcttcagcgatatacagatcttccttcggctctaacgtttcagtgaatcgcttcattcgggtcacagactttttttcatctaagcatgtcttgactgtcatcagatgccgttccaattccccttttacaggctcaagcaacaccgtcaaaacaccattacagccaatgccctgtccccaggataaatcgtcttccgcactcatatcaaagcggacaatcaacggttctcccgcagaccagacctgttctgccctttcaacgagatcttcttccagacaaccggcggataacattccgactcttgttttatcctctaaaatcaacatcgaagccccttctttcttataagcggacccctctgtttgaatgatggtagccagtaccttagctttcttagaattagcgatgacatccaaaatccggtgtatatcatccatctcatgtcccccgcttttacctgatcatatctgtatatccgtattctctttttccagaaaacattacaaacgcttcagcaatttcttcgtttctaaaaaaaaagagtctttatagaccttatgaccgggcggcgggtgcgacagcatgtcggagcggagagattccaataacacgttctgttccttctgtttccgattgtctgtttcaccctgctgtatgcctttaagatccgaaaagtattcacttaacacttgtaaatcattccccagctcccttttatcacttgaagataaagctccttctttttcccattcttttaacgttttcactatatttgacagatactcaaatccggcgttcaacttttgcatctctatttgatagcttgaaatgatgtttttatgtttttttctgacggggttgaattttaagctgtcagaggctgtttgcagcatctcttttgccgtatgcagctcctgcagaagatggttcattttatattccataaggttcccttttccttgtccccactctgattgcacccatttggaaaggtctgaaagtgcgtcggaaagctgacgggccaatgtttgaaaagagtccgctgccttttttgtgtagtccggcggaaaaaggaacatgtgaatcagaatggcgatgatgacgccgatcaccgtatcgatgattcggtcgaatgcataatctttagagtttcgttcaaacgtaaagaccaataaaatggtgagcgctacctgatgcagaaccgttacatctattcgtaaccactttgcaatgtaagtcccgcctaataggaacagccccagcatccagccattcattggcaagtgactgacaagaaaggacgttagcatgatcccaatcgcagttcccgcaatacgatgaaaagaaaaacgaatcgactgatctatcgttggctgcaaacataagataacagacagaggcgctaaataggggtgatcagagcccgccagttttgccgcttcccaagaaaccgcagaggcaatcgccatcttccaaaccaaagatgttttgttttgaattttttcacttttcatcatacgccccctcctttcagaaaccttttccactaggtttccgtgacggaaagggatttatactgtcgtgtggaaaatgcggaagaagctgttgttcgcaataaaggtgcttctctgagctcttctttacggtttctatcctccttgataacttcgcatcagatatgaaccctgctctcctatgactttcgaagggaaacatacaaaccttgttggttaatgtgatgaaattgggtgaattttttatcattttatatggtaaggctttaacaagcagaatgcctttgttagtatggcaaccaaaggaggaggatcaattatgcaaagcagaatgaagctaaccgcagtgaaactggcagccttggtattcctagcaggtgcctttgccctcccggttttacctcatgctgcggctgccgcaggttcccaagctacatacaaagttgaaaacctcaacgacagtgagctgaagatgacgttcaatcatgcagatgttcatattgacgctaaaggcaatgcaaccctaaaagacaacataacgggcgaggagcaggctcttccgaaaagctctactgacaaaaatggtgaccccgttacactgaaatatgaaaaaatcaaaaatggcgttttagtcaaagtcgtaaacaaagacgctggaaaaacaagcgggtcaatcagcacccaatcagtcgggaaatgtattctaggtactggcggcggtgcggtaactggcggcggcacactgggtcttgcaggagctgctgtaggaacagtcacaatacccggcatcggaacagtaggagcgggtgccgtcggagcaattaccggcgctgttggcggtgcaatgacgggagctgccgcatcttgcttttaatcatgaaaaaaaaagggcccgcgcccctttcttttactaactatggaaggtggtcgacatgtacaaaatcatcattccttcaatactagccatcttcattctctggatactcttacagatttcgctggagataagtatcgttaagaatccattgaattattttattgtattcattgtcttctttctctttataaagatggtgaaagagaagcaacagtaggttgcttctaatcagctgtggggaaccagattttagtggatctggtttttttgttttgttcactataagccaacaagtgatttcatagtaaatcgaatattgacaacaaatcggcctgctatacaagataatcgggacttatgatcttggtttaccgagtctttatataaaaagtattttcctttgacataagagcatccgattgattaaactcaaggctttatctccctagaaatatttagccgtcacagtttactgcgatatgggtattattttcttgtacggttagtagaataatcactttaaattcacttttagcaaatgcatttatataacttccccgcaaaggaataataatgtgtttatcctattgcctatacagcacagagggattaacaaaaccagcgttttatacctaggtctgttaacatgctatataaaataacataaaaattaaatgtaaaataatatagagaggctccaattaattcattatgtcattcaactcagagaattcatcttgcagaattctaaaaccttcgttaatattcttttcatatattaatcgtcttttatttgtggattcctgagaatagaaagaaagatctatttctactccttcatttttaaagagctcagcacttgagatttttgtgaatggtattaactgacccgttctaatatcttgtaaaacccctttaatttcaaataaagttaaaagctctctcaagtttttgtcgtgggataagaaaaatggtataaaatatcttccttcactattcaagttagagaaatattccattaccctcggagccataaaatcccaagctgtgttttcaattttttcgagtaattttttttgattaccacctttattaattttattaaatatcccaacagatttaggattcttgaaatatttaagcgcaataaccatttctctttcataataaattcctactttattttggacatattcaagtaacttaatcattttattttttgcatttttttttgaactgaactgtattttgataattccgatcagaagtaatgttaaattctgatgcatatctaagaacttctttaatgaacttttaccatccctagttttatataatttatatattatatcgtctactctttggatagcctcaaacttcgaaatttggtattcaataatattcttatttatgtatatatcattatcaatgcttttaaatagctctaaaaatactaaattctcgtacatatccctatgtttttttatagaagcatcaaaactcccattatctttaataattttattataattttctactaaatagaaattataatcataatgaaatttatgttttagtagagtatctatagttttgtaaatactttctttctcaaattcactactcccttgattgttcaaaaagcgaggaatataactagcataattagtatctaacatcacagaatagtcaataggaaatgatatacttccattaaataacatatcattcagtaattcatcatccatgtaatataactttccggtttgaaagtaagaaataaagtcttgatcaactgcatttaccaattctcccaatccaaccgggaaagtatctttatcataattatctaggtttatactcaacttaaagtattttaaatgttccttgtgcttattccatactaaaaatacttcccttggtgtttctgccgttgataaaaaataaatcacctttcttaaaatcatttcttctttcatgtatttactccttaataatttgttttcaaatttgaaagtaaattatttgattcacatttattatctctttttttctaaacaagtttattgagtaatattaattgctctagtctgtatatatttttgtgcttctgtcctaaccaaataatgattatctatggaagctttcttcaatattaaattattaactttggaatctataattgctaatttttcaaagtttcctattataagattttttatatatacattttcataatccatagattgtgaaagctgagtcagtataactttttgagttttggttgttatcatttttagcaatgctttaattgataaataccgtatatcttgatttttgtcattcttcaaacttaaagtgaattgaataatgatactacgaatatctgattctatatttttaaatgattcattatttatagcatttataatggcctttaagcattggattttttcaaactcatcctcattattaatttcacttaatagatttaataaatcaacattatctagttggcaacataccattttaagcataaaataattaatctttacggttaatgtcgaatatttttgaaaaagatcatcttttccttcaaagagatggttttcgtgtttaatcaaatattgatataaatctttaaaattataatcaatattttggaaattctgtttaatataaatagttaattgtaaagcactcaccttatcagaatacagtagattagttgcacataacgattcattacatacttgaagaacttcatttaatagatagttatcaactatttcacaaccctctttaatgatattttggattattagatatgggttttgcgctttcacactgtaaatcccatttttaccttgtttctcaatttgttccttgatctcctgaacataactcataatatggctttctcttttgacactagatgtttctaaattataaattttgcgatctgattcagacatgttacttaatacaacttgatttaattccgaagtacccgctattatctgttttcttaaatttataattgcatataagaggttatgacactggtttgctagattagaatctaaaatgattcctttcaacaaattctttattttttcaaggttttgagtagatatccctttaaaacttattattcctatcaaatttaaagcatcatcataaaagcgaaacatctttttttctaaaatttttatgcatactctagatatttcatcggcttcgattctattgatattttctttcaaagaatcaaatattaattttcccatagacactataaaagtattatcaatataattatgaatctcttccaataactctcttttgatacacatgtaatcttcatcgctaaaataataccctaaatgtttaaatacttctagcttagattttattctttctgattttaccgggaggcagtttgtaaaattataaatattttttacatcaatataattgatttttcctaatatgctattaaagtaggaaattatattttctgtttgcttgctatctccaactattactgccatttttaacagcaacactctgaattcccaattggaatattcctcacataattgaaatgatatatcttttattttatttctcaataataataattgagttaaagatccattaaaggcaccaacaatataaatgttagtcaaatatttaatataaacatctaaattactaccaaggttaacagtatacacagtttcagttttcttttttgttgatgctttattaatttctttatataatagcttttcatatctatcaattgatgggtaaaacagagattgacgcatactttctaactcttcttgtgcagcattcctagaggagaatttattttcctgatttaacttttgattttctatatttattaaatctatcagtatatcctgtgaaatccaatcaggcaacccactttccttacataagtcaaaagcttcctttaagtattttaatacagaatcaaaatcatcgagccagtaaaactgaatagctttccatcttaattttactactagatgcatattatcactttgctctttttttatttgctctaaaaataaatccccattgaattcttcaatacttttttcaccaaataatacttttagaaattgctcataaaatctatctaattcactcgtttctttcacttctttattaacagaaaatatcttttttccgatatatgcttttgatttatcaattccttgtaaaatacgtttctctagtgattcagaagctattgaacctatttctattttattctgttcagaattgtgaaattcttggtctatgagtctatttttacaatagtgtctataaatattacatatgtctgttattaaatctttaaatccttgatttgcaaattcattaaaactattaactatataatatttagctccttttgctccaataagttcttcttggatttgcgtaggtttactttctttttcattacaaaatagatatattgacttttttgggtgtgatttggctctagttatttctctaacaattgcagatgtaacatcatctttattatctattaagaatagacatacatcactatcatctagggcatataaataatcctgttctgcggactgtgtcgaagctccactttcctcaaatagatatacatcagcaatctttgtcgattcgataagtttttttagttgttttcttacttcatcatacctttcaaaaccttgtccacaccttgaacttataaaaactttaattttattaggtaacaaaatgtcattcttcaaatttcaacaccctctatagattatatttctattgtaataaacgttaattaaatgacgacttaaataatataaaatttatcatagtctctatctaagtgagatttgaatcatttttgattaaagtcttcgaaacatccctatggtaacaagcttaattaagactaatgacagttgagaattgatgtagctttatgtgaatttttttaaatctaatatagagttacttaagcataaaaaattaatagggaagctttatactccccctttactcttatctctataatattagtcttccttaccttgaaccatattaagtccggctctgtatagaaatggtgtccaataaggtttatgactaccctttttttcctcaaaaaatccaatagacactaattcatttgcaatatttattgtatcttctttgtttattagaaatatttttgaaagggtaccaacatcatgttcagttttctggtcttcaagtttttctatgtatttttttagatgtgcatattctgcataaattgtttgctctaaacgaattttggatactacttttaatgcgtccttcaaagcacttcgtcctatgatttctgaataagagttttctggagtaccagtttctaacaatttaatttgttttgccctagcctcattcattaaatgaatgagttctcttggagctgttatttttaatccatccttaacccgtccaatcatccatttaaatgtttcaggattctttcctacttcaacttttttcgggaaaatagaatagaatatttttttctgcttgtcactatcttttaatacatcatctttttccacattaaaaaatttgcaaagaatatcgttttcaagaatacgactaaccagtaaatgtaaaaaatcctgttctgaccaatcaatcgtcacttgctttgttatatgacttgcctccctaaaacccgttttagtaattcgtttccaaatatcctctctaataaagatttttaattttatatgtttgtgcagttttatattattgtaaacctgaaaaagtgttcttagagctaaggtttcaaattcaggttttccgggaaatgctacatcaagtctatcaaatgttatccaaacgcttaagtcaacacttttaagtgcctcattagccatttcaagaagttcaaaaattgatatagctcctaattctctatgttctttacttggttcatttaaagagattttcccttttaaaataggtatattagttgtaggttctacggttactactccttcaacttcttttacatttctaaagaattcaaaaacataatctctaacattcgtaaggagacgtcttatccctttaccttctaataaaccttctaattcaagtcttctaataaaatcttttacttcttcgcttctattacgaaaatctttgattttatcacctatcagagtaatgatatagatagaccataggtactgaaacgaggtttcagttaaatcagcatcaccaagaacagatttaaaaacaggtgtgccctctaggttttctgcaggtattaataaggtgtttttcgcagcaaaactaccctctttttttaataattgcatatataatgcacttttacctgaacctttcactcctcggactacatcaatttcccccatcaacaattgattccatactgccgtttcaacaaaatacgatgctaaattctcatcctcttcggctaccctctccccgaaacgcgagttcataagtaaatctatttttctttccaaaatggtcatcctttcattcataatatttccatatgaatatattataacaaaatatgatccttaacgattatttttatgctgaatacatcaagaaaatggtatttgcaaacctcactcacttatgataaggctccccacgattaatccgaaacgcccggtaaatctgctcaactagtatgagccgcatgagctgatgaggaaatgtcatttttgagaatgacagtttgtcgtctgcgcgcttcatgacggcgtcgcttaggccgagtgagccgccgatgacgaaggtgattttgctttttccataagtcgccagcttatctattgtatcggccagttcttcggatgttttcatttttccttcgatggcgagggcgatgacgtgggtgtccgggctgattttggccaggatgcgttcgccttctttgtctttgacgattttcatgtcttggtcgctcaggttttccggcgctttttcgtccgggagttcgatgatgtcgatttttgcgtaggctgagagtcgttttttgtattcttcaatgccttgcttgaggtatttttcttttagttttccgatggtcacaatattgatattcacaggtcatccccactttagaaacaagttattcatatatattgtccacaattgtggatatcttttctgtattttgtgtaggatcattcgttccctactagatatgttgcagtgtccccacataattcacaggctgtggataaactgttagtatgttcgatttttctgatttcgggcggaagctcatgatcatctatgtacatgtccagcacggtttcgatatgttcttcacaagaataataagcggttttcattgttacatcctccggttttcttttgcgcgcggcaattgttctcttttcaatataacctatttatacacatgttagtagtgcttcgggctgagttttatccacaattcggcaaatcacgcgcaaaaagagccggtgttttcagcatccggctctttacgtgttttctcttttttctaagcgaaggacgaacagaattcctaatagacacgccagcagcgtacagcatacatcaatccagtccggctttccgccgtttaaaaaagagttggttatcacggaaaccaggagaatggtgacggtcaccgcggcaagctttttcttcatcggctccctccttcatctgactgtcttctgcttttacggttcaaattcctctatttctttttcttgctatatagccttatcatgagggtcacaacgatatatacaatcataatcaatgccccgttactcacatcagggtatccaatcaacatattcattatgacaaaaacaatggttatacaaatgacggacaacaataagaagatactgaatgatttcaaatgaacaccttctttcccgcagtaacgtttcattataaaaagcttaccaaaagcggcaagctcttccgaaatgttcatactctttaaaacccatccatcacctgcacatcatacagcttgagatggcttttcggcgtgacgatgttttttaagtttgggatggtcaggtcgttcagctttttgcccgttttcaggtcgaaggattcgattttggcgggctttttgtagctgtacgtgaacagatacagctttccgttttgatgggtcagctccttgaagtcggccttcattcgtgatgcggggagggtgaaggcctttttgctttttccggtctcagggttgatgcggtagacggttccgaagccgtcaacgaaatagaagctgcgatgctccatgaaaaagctttttttgaagctgaacggcatggagtcatagatcgtctgttcgtcatttttataagcggcgatgtcatacgttttgatggcgccgctgtttttcatgactttcaccatttgatagatgtgatcggctttttctcctctggtaacaaagcagacagcgctgtcgtccacggcgagctgggattcgacagacgtgccttctttatacgtccacgtcgcgattgatgttgtatggagcttttctttatcggcctgaatgtcttggacgtgatagcctttttcgtcatctgtcggcgtgagcgcgaaaagatgatctttaaaaaagcctgaggcgcggatatagtgcgggatgacgtcttgcttccacctgccgtccatctggcggtacagctctgagcgatagctgccgccgctcttgtcgtagcccgaattatacagcgtgtaaaagcctttcgcccgttcgatatatcccgcgctgtctcccgtatgctggtacgctcttttatacgtgtgaaggccgtcctgaacggtgtagattccttttttgtcctccagcagcacgctttcgtcatgcactttggccgatccgagctcaagccccttcatttgataagaagaaagccgccctttttcatcggcgaagagggcgtagctttttccgccgccgaacgtgtcttggtcagccgcagtggagaaatacagcaacgcctctttatctttcagaaaatcagggtcatttaatgtgtctctcgcaacctccgcagggtcttccgtgcggaaatagaagaagcataagaccgctgcggcggcgatgatcactaagggtatccagatgatttttttcacgttgttctccttagtgaatggtcaggatcgtggttgtgtaggacgagcttgtgatgtcgcgcgggtatacgcctaagccgccgttagagtcgatatcaatccccgcttttaaaaggaatgccgaccacagcagttttgagcagtttttggcgccttcatggcccgtatttctgttattgacgaagttgaaggagtactcatcacccactcttgatacggcccagtcagcggcggcttgtttttgagcatcggtaactttcacggtctggacgattgaattgtcttcgacttctctgccgttataagcaatctgacggacgccgtctcccggcacggattcgacaattttatcagcggatgaatacatgccgacatgcccgtgattgtaataagccgtgtatgagttcgtgtaataaatattgccttttgtgcttttcgggagttttttggttcctgacgatccgcccatcgcagagagtccgtctttggaagcgattacatttccttgcaccttgtctgccgtgatttcttgatgaaactgcttgagaattgcttctgttgaaacgtgcttctgtttggcaagctctttggcggattggagaacgtcttgaggagtcgtgccctgctgaaggtctgcgatttcttttgcgtagcgtggtatttctgtttctttcgcttttacattcaaaccggagaacgacagaaccatggtgaatgacagggcaaacgggaggacggctttgaacagctttttacacattgacttcgcctcttttctcaaaggttaatttttccacgttttcattatatgacgaaattgtgataaaaaaatatacaatttacagatttttaaaaattttataacaatatgtaaatcatatacataaatcattttcaaatatcaggaaatctggttatcatacaagaaagggggaggacatatgaaggacagaacgatcggttcgatgcgggtttccgcaatgggattagggtgcatgggcatgtcggaatactatggcagccagagtgaggaagagtcgatctccacactgcatcatgccgttcatctcggcgtgaatttgtttgatacggctgatcaatatggattgggtgcaaatgaagaacttgtcggcagagcgctcgccccattcagaaaggagctgtgcctcgcgacgaaattcggttatgtccgaagcgaaaagggtgagtttatcgaaatcaacggacggcccgattatgtgaaaaaagcgtgtgatgccagtctgaaacgccttgggacggattatatcgacctttattatctgcaccgggttgatccgcgggtgccgattgaagaaactgtcggcgccatgaagaagctgattgacgaaggaaaagtgaggtatatcggattgtcagaggcttccgcagaaacgatcaggcgcgccgtccgcattcacccgattgccgcgcttcaatcggaatattctttatggagcagggaagcagaggagcatgtgctgcccgcctgccgtgagctcggcatctcatttgtgccttacagtccgctcggcagaggttttctttccggaaagatgacgtcgacagatcagctggatgccgatgattacagaagaagaacgccgagattccagggagacaatttggcggtgaatatagggctcgtccaaaaatttaccgccattgcccgggaaatgaatatcaccgcgcctcagcttgcgctcgcatgggttctcgcaaacggcgatgacctcattccgattccgggtacaaaaaagaaacactacttggaagagaacctcgccgctctcgacattgtgcttccggaggatgtgaaggcgcggttggatgaaatgtttccgatcggcacggcggccggcgagcgttacccggaacaaatgatgacattgttagatgaataacaaaagaggcccatcgtgcgggcctcttttcatgacagctttttgctcataatgacatccgtctccaggaatcccgtcttctcatacagcttccgcgccgtttcgttatgagcgaacacatggagagaaatcttgcggacacccagatctttggctttgtcctccagccttgcgagcgcctcttttgcatagcctttgccgcggaaaggcggatgaaggccgaaatcataaataaatgcgtcctgctgcgggtggtccggatcggcgtgcagccacaaccagccggcattttcctttccgtccaatgtcagcgtccataaatagtgatcggctgtctccaagccgtctggaagcaggtcttcaaacgtcagctccgctaattccggcgcttcgtcaggcagccacgttcccgcttttaccttttcttcagcgtaatgcttggttgaatgagcgagataggactgaaactcttgtcctgtcatcggctgcagcgtgatagccattgaatcactccttacacgaaagcgatatcatgcagtattatccgaaggctccgttttccgccggttttatgatttgttcggcttgtgccgttgaaccagtttgtgcaaataatccaatcgaaatgagacttgccaaggctgctgagagtacaatgaatttacatgttttcattacgaatcccctccgttaatctcaaaatttggtcattggcatcaattgattcctgaaaatacttcgccgccggtttgtatttctcctgttttttaaaatgcgccgcggcctgatacgacaaatcggaaacgtcactccacagctctttccttcttaactcggcgaaagctgattcaagcgcttcttcattgcggtcaataaagacatgctgtaagatgcgcagcttttgggtgtatacgggctcgtttttttcttcagcggcattcagcgctttatgcagccaaaatcggccctcatccgtctttgcctgcttcaataacactctggccagcatgtacagactccgcaccgaatacgctgatcgcaaatgctccttttgatcaagagccgtttcaaactcgacccgcgcctcttccagtttttcctgtctttcatagcaaatgcctgcgttaaagtgggcgagcgcttcaatatgcggatcgcccgctttggcggcttgatgaaccgccgtctgcaggagctcttcggctttctgatagtggaacaagtccattctgttacagccgatcaccattaaacactgtgcttctctgaccgcgtacatttcattggctttgtagatctccaacgctttttccgcgtggttcatcgcaaagtagttttggcggatttcatagtaggcaatcgccacttgataattaaactcggctctttcaatctcattcggtatgtgccggagcctgctttcagcaatccggtaaaaattaatggcgttcataaaccgtttacggtaaaactcgtgcattccggaaaagaaataataatagtattgaatcatctggtctgttttttctttatcggcgttcagctggatcgtttttaaaatgccgtctgttttctcatactcttccattaaaagcttatagcgggaatcaattaaattaaaataaaggagcaccgtttgattttgtgtcatattttgcagatccgtaagcagttgttctcttaacgcctcagccgattcagtgttgtgctttttgatttcctcataccagtcactgatttttttcgcaactgtttcgtgggccatcacctcagccatctgtcaggacacctccctttcccattttgtgtaataaatatatcatatttacaggtccaaaaagagggtggcagcccgctagtttcctcgtggcaacaaaaaaaacctccgcaggtgcggaggcgcatattttataatagtttttttcctaacaaagattctaccagctcgaccgctgttttgccggttttgtttttgtgatcgaggatcgggttgacttcgacaaattcagctgaagtgatgatgtcggcatcatacagcatttccattgccaaatggctttcacggtagctgatgccgccgacgacaggcgtgcctacgccgggtgcgtcgctcggatcaaggccgtctagatcaaggctgaggtgaacgccgtcacagtctgacaggtagtcaatggtttcttcaatgacctttgtcatgccgaggcggtcaatctcatgcatcgtatagactttcatgcctgtttccttaatgtattcacgctcgccttcatcaagcgatctcgcgccgatgatgacgacgttctccggcttgattttcggggcatacccgcccagattcaccaacgtgtcgtgcccgacgccgaggctgacggccagcggcattccgtgaatattgcctgacggcgatgtttccagggtgtttaagtcgccgtgcgcgtcgtaccagatgacgccgagctgtttatagtgctttgccgttcctgtcagcgttccgatcgcgatgctgtgatcgccgcccaagacgagagggaaccgctcattctcaatgacgctgtccaccttttgggcgagctgctcgttccccgagagcacagagttcaaatttttcagctcttcatcatgtttgagtttttcacgattgacggggatgtcgcctaagtcttccaccgcataccccatgtcagataaccgttcaatgagatgcgcgtagcggatggcgctcgggcccatgtccactccgcgtcgtgcttgtcctaaatccatcggcattccaataactgagatattcttgttcatccgtttttccacctcaacatgttgtatgttgtcctgtgcgggtttctcaaagatgacttggacacgaaaagatttaaagctctatctgtttttctgactgcttatgcttttttacatacagatgatagacgataacgcacaccgccatgaacgggatgccgcaataaagggcgagccgctgttctgaatcaaatgcgagactgatcagaacgaccgtatttaacgtcagcccgataataggcagcaccgggtacagcggtgttttaaacttcaggtcttccactttgccgccttcgcggatgtatttccgtctgaacatcagctgtgacagggaaatcgtaatccagccgacctgcgcgcttagtccggctaatgataagagaaacatataaacggtttccggcgctgccactttagacagcagggacaggcaggcgacggccagcgtcacgatcagagcgttcatcggcacgccgcgtttagttgttttgccgagcgatttaaaggcttgtccttcgttcgccatggcatataagatacgcgtcgatgcaaacaggcctgagttggccactgagagcagcgcaattaagataacaaagttcataatatcggccgcatatggaataccgatttgttcaaacaccacgacaaacgggctttcgaccactcccgccttcttccacggaatcatgccggcaatgacgatgatggagagaacgaaaaagacaagcgttctccataccgtctgccggatagagcgcggaatcgttttctcgggattttcactttctcccgcggcaaccccgatcagctccgttccctggaacgcgaagtttacggtaatcatcgtaataagcatagccttaatgccgttcggaaacaatccatcctcataaaaatgagagaagaaaggagcctgctcgccgtgtttcatgtcgatcaggccgaacatggcggcaccgcccaaaataataaacagcagaatgactaaaattttaatgccggaaaaccaaaattccgactcagcgaacgcttttgtggtaatcgcgttcaaaagaaacatcagtccgacaaacacgaggcaccacacccatacgggaacatgcggaaaccagcggagcatcaattgtcccgcagataaaaactcaatggcgcatgtcaccgcccagccgagccagtacagccagccgaatgcgaaaccgaaagcggggctgatgaatttggttgcgtacgtctgaaacgaccctgatacgggaagggcaaccgcaagctcgcctaagcagagcattgtcaaaaacataataaaaccgccgaccagataagacagaaccgcgcccagcggtcccgcctggttaattgtaaatccggtactcaggaaaaacccggtgccgatcactccgcctaatgaaatcataaacaaatggcgcgatttcattgtgcgctgaagctgattctctttttgatttgtattcactattctgcaccccttcagcaacttgtattggaaccaagccggtgctttgaaaccgatttgctgtccaaagagcctctatttgtatatgaatgttatatgaaattcattttcgtacataaagatacattatactaaaatactgtctccgcgcaaatagagtgtgctgaattttttatttgtaaattccatacaagccgagggaaagcattgccgcatcaaggtattacgcgttttgaagcacgtttgtgatcttttggatcgcccagtccaagtcttccttggaaatcattaacggcggtgcaaaacggatcacggtatcatgtgtttctttgcataaaagcccttcgcctttcagcttttcacagtacgggcgggccgcttctgtcagttcaacaccgataaacaggccgcgtccgcgcacgtcttttatgatcgggttatcaattttctcaagctcttctttaaaataccggccaagctgaagggaacgctctgccagcccttcttcctcaaggacttcaagagatgcgagcgataccgcgcaagcgagcgggtttccgccgaatgtcgagccgtgggaacccgggttaaacacgccgagaatgtcacggttcgccgcgatgcacgaaatcgggaagacgcccccgccgagcgctttgcctaagatgaacatatccggtacgatattttcccaatcaaccgcgaatgttttccctgtgcggccgagtcccgtctgaatttcatcagcgatcagaagcacattttcttccttacaaatagcggccgcttcttgtaaaaatccttccggcggaatgacgatgcccgcttctccctgaatcggttcgaataagaaagcggctgtgttcggcgtgatcgcccggcgcagcgcttctgcgtccccgtatggaattaattttatacccggaagcataggtccgaaaccgcgtttatactcatcttctgaagaaagggataccgcaagcatcgttctgccgtggaagttgccgatacacgcaatgatttccgcctgattatccgctactcctttgacctcatatgcccagcgtctcgccgctttgacagcggattcaacggcttccgcccccgtattcatcggcagaatcatatcttttccggtcagcttggctgttttctcataaaacgggccgagctgatcattatggaacgcgcgtgacgtcagagtgattttatccgcctgatccttcagcgcctgaatgatcttcggatgtctgtgcccctggttcaccgcggaataagcactcagcatatccatatattgattgccttcagggtcttttacccaaacaccctgcgcttcggaaataacaatcggcagaggatgatagttgttcgcgccgtaatgtgaagtttgactgataatttcttgagattttgtgaaagctgacataatctgattcccccttgttttgtaatcattcaacattagatcttgctttccctttttataaagcaagttccgtgccaatccgaaaaaacgggatgtttcgccagcattctttcttttcctgcaaaatattccggcagtttgcgtgcaaacttcagccaagcgcaaaatttttttgcgtttcctgttcgatttattttaaaataatgaatgttaagacgattgagagggggaattgacctgcacacaaccagcgaattttacacactcgtgttacaaagcattctggaagagattgatgtcgggctgcatgtggtggatgagaagggcagcaccgtcatttacaataagaaaatgatgcagattgaagatatggatgaacgggacgtcctgcataaaaacctgactgatgtatttatgttttccaatcagcaggacagcacgctcgttcaggcccttcaagaaggcaaaacgattaaaaatgtaaagcagagctatttcaataacaaaggccaggaaatcacgacgatcaaccacaccttcccgattgtgcaaaacggcgagatcaagggcgccgtggaaatcgccaaggacgtcaccaagctcgaacggctgatcagggagaacatgcacagaaaagaacagaacagctacacgtttgacagcattctcggcaacagcccggtcattcaggaagtcatcgaaaacgcgaaacgggcaacccgtacatcatcgtccgtgcttttggccggcgagacgggaacaggcaaggagctgttcgcccaaagcattcacaacggcagccagcgctcaggcgccccgttcatctcacaaaactgcgccgccctgccggacagtctggtcgaaagtattttattcggcacgaaaaaaggcgcctttaccggagccatcgaccagcccggcttatttgagcaggcgcagggaggcaccctgctcctcgatgagatcaactctctcaatctcagcctgcaggcaaaactgctccgcgcccttcaggaaaagaaaatcaggcgcatcggatcagctcaggacaaaccgattgacgtccgtatcatcgccacgatgaatgaagacccgatcaccgccatttcagaagagcggctgcgcaaagatttatactaccgcttaagcgttgtcacgctgatcattcccccgctccgggagcgcaaggaagacattctgcctctggccgaagtgtttattcagaaaaacaaccacctgtttcaaatgcatgtcgattcgatcagtgacgatgtgcagcaatttttcctggagtatgactggccgggcaacatccgcgagcttgaacatatgattgaaggcgccatgaactttatgacggatgaaacgacgattacggcggcccacctgccttaccaataccggatgaaaatcaaacccgctgacacggaaagcaaagcagccgcaagcacccagcccggcacagatttaaaagacaaaatggaaaacttcgaaaaatacatgatcgaaaaaaccctgagaaaacaaggcaataacatatccaaaacggcaaacgagctcggaatcagcaggcagagcctgcaataccgcctgaaaaaattcggtctggaccggatgaaatgaatccatacaaaaaaaggctgaggtgctcctcagcctttcgtttatatctgattggcaagccgctctccggtaaaccaaaagttctcactcactgccaatgtatgttccgtattctcgacttgatgccaccaatggcgcggcgcgtaaatgatttctcccgccttttgcctgaagcggatcggagacgccttttgcgccagcggtttttgctctatatctttttcatcaaagacattgatatttccttcgtacaaatacggagagtcgtccggatgatagaaaatccattccttctccccgaaaatgacgccgttccacgcgtgcgtgctgttaaaatcctgatgcagcggcgtgcctgtctgcttagaaccgagaaagaaccatttccagtcccgtcccgtttcttcatccgctctcaatgtgtcttttgtaaaatactcgggtgcggaatagacaaggtctaagtcattttggttcagctgcgtaaaattccagtcacagtaccatttgtcatcattctgatcaatgtactcgatatagttggaaagctttacttgtttaaacgttttgaccccttcgatatctgatttccggatggtgaccattctgtctccatagtgttcgtcaatgtattcaagcgtccacggcctgcattcccagtgatccattgcccccgtcaaaataaaaggtttcttatcagcatactcgcttacaaaaagatcgtacgataactcattgattgtcagtctgtcaatggtcatatccattccccttttattcggcaatctgccgttttttttgtttggcgtaactgtatggacctgaaaagatggtgacgttttgattctcaagccagaaaatcttgttgaacttctccagcaggtttctgtcgtgagaaacgcagatgatggtgccttgaaactgcatcaggctgttttcgagaatttcctgagattcaatatccaagtggttggtcggctcatccaggatcaggacattcagctttttttccattaagatggacagcttcagcctgattctctcaccgcccgacaggacggaaagttttttaaagaccgacgacccgtaaaatccgtacttggccagcatattccgggccatgccctcttcagtcagcagattttctttaaagaattgcagaatcgtctgactcgaatctccgacgtggctcttttgatcaatgtagcctatcttaagattttcccctactttaatggtgccgtccgacagttctctttccccgatgatgcagcggatcagcgttgttttgccgacgccgtttctgccgacgatgccgattctgtctttatgctttatacgcagattcacattttgatataaaagggaagatccgttggccacctttccgttttcaatgaacacaatatcttttgaaccggcgcccgcttcctgaaatgcgttttttaatttttgctccgtccggaccggcttattgatcagctcgatccttttcagcgccttttccatattattcgcgcgtctgtgcagcccgacagacggcggattcgagcggttggcccaatctctcagctgggcgatggattccttcatcttctgtatttttctctgctgttcttcatatttctcaaactgggcgatgatgaattcttcccgctttttcaggtattcgctgaaaccgtaaggccaaatcttcacctcggtatcgtcaatctcgagcactttcatcgccgtctggtcggcaaacgttttatcgtgggtcgtaaacagaatggttttattcgattttttaataaacccttcaagccactcaatcgcatgaacatccaaatggttggtcggctcgtccagcagtataatgtcgtcgttgcggattaaaatttcggcaaggccggcttttgttttttcgccgccgctcagctttgaaaacggctgatcctttaattcgctgaggctgagcccgttgcatacctcgtcaatcatcgcatgcatctggtagccgttgttccgctcaaatgtttccgtgtattgactgtacttttccaataaagcagtcagctcgtcctcacccatcggttccgaaagcttcagctcaatggccttcatttccttctggatcgccgcgagagcttcaaacgatttttccagatattgatacaacgtcagatcctcatggggatcagcgatctgcttcagcaaaccgaccttcgcccctttgttgatcgcaatcgttccttcatccgcctcaagctcccctgaaagcaccctgaacagcgtgcttttgccggaaccgttcggcccggccacaagcactttttcgccttcattgatgaagaaagaaacttgtttgaaaatggtatctcccgctaaatttaccgtaagattatgaatattcagcaactcacatcatccctttgtcattctggttcaaagctcgactttattctggatggcgacgctcgctttcagtttgtaaaagctgagcatcataaacagcgacaataagatggataataccccgattgcggtcagcagcaaagctgaatcaaaatagtccgttaagaatccgataaacggaaaggcaatgaacatgaagagcgaggtcatcaaactgataatggacagcagcgtggctctcgttctggacggaatctcattattcaccacctgactggatacgggttctatcacatcatagagcgcgttgatgacaacaaaagctgcaatcgtcacgtacagactgcccgaaggtataaacagataggccgccccgatgatgcagaatgtcagcagaagcacgcgcctcggcgtgaatttttccgccggctttgaagaaaagatggagcacagtgcctgcaagatggacagccccgcaaaaataatggatatattgcgcacggacagcccttcctgacttaacagatcttgtccgtacatataaaaaaccgatgtaatcgcaaagaaaacggagagtgacagcaccaaatatttaaaggctttgttcagcctgaagaaatctttgacttcttttaagatgtccccgaccgtctgcgtttcgtgttcactgttttcaaatttgatctccgtcagctgtgtaatgaccgccatcgcaatcagctgagtcacaatcccggcgataaacacatacgaccatgatatttcctgcaagtagccgccgatgcccatggcgatcgcaagaccgagtatgacaagtccgttataatttccgatggatttgccgtaccacttttctttcccttgttctttcagtgaatcaaacaaaaaggcgtgatccgttcctgatataaacgtcagcccgataccgtatataatatgagcgatgaagagggcgatgaagttatggaagctcaggaacatcaccaaatagacaatgaccataaaatgaccgagcaagagcgatttttttctcccgattctgtccgagatgacgccgctcggcacttccgccagaaacatcgccaaattcaggaccgattgcaggatgcccactagaaacaatgaataattcatgcttgttaaatataaaatccaaattccccgttcgaaaaagaagtttccgaaaaaaccggagaagtaaagcaaatttcgattccgcaaatgaatacccctttccagctatctgcatttaacatcatgaacagaaaggagcccgtcagtctttacactaaaaccctctatacatggatcttgcagatacagacttttcccaaaacaaattgggcaataatgagttgtattctcgaataacccaaaaagttccttctttttttcagatcctatggcatcaatgatcgtttttttcttccccggatcgctgatgtcgcgaatgaaatatttgatatagctcagctcatgcatgtaagccggcaggaacaaatgaagctcaatatcaaacccgcttttatccatatggtaataatcattgaaatgactgacgcgggagacggatacgtccgctccggccctccgaaacaattcagtcagcctttcaatgatctctccgttgggataataatcggcataaacaattcggatcggctcttcttttgtcaaaaggggcggatctttctgcggtgtccgtccgctttcccatataccgatcagtgaatcagtcggtgtgatgatatgccccaaatcgccggccagcttttgtttatcaaaataatgctgaatgaaagttctcagcatgccgtcctttaccttgaaggtaaataacatcggcaaatgattttctttaaaatcagcatactgccgatacctcatgttggaatgatgaaactgggtgtggcaggtcacatcggtctgattcgcttcgtacagccagatgcttttttccagatcatcattcaaaataaattggatgatctgaacggtgcggtgatccgcgggcgtcattttatattgcggattccgctcaaattccagtcccttctcaaacgtacgcttgaatcggtacgggccattttccggcacatcgcccccggcggtcgccggaatcagaaagctgctctgcaaaacggcttctatttcatcagacggctcgtccaaggtgacttcaaagcgtttttcgcccgttacgttcaccccgagctgatcggatgagacgaggccttttacatacggaacggcctgttttatgttcaggaaactgccgagatggggactttggttttcttttgtcagatgatagatgatcgtttgaaccacaccctcggcgtcacctaaatagtccgggtgaatgtccacctgacaggtgcggcgatctttgcggatgattcggcagttatagccgtcctgcaggctttcatacataatgctgcaaatcatcttgcttgtgtaatcctgcgtatctaatgggttcaagcgtatcgggcttgtgtcgatttctattttcagagggtcgcccggttttctcgccgtacgatgcatcgtcttcataaagcgctttccttttgagaaagcttcgtttctgtaatatgaagtccgtcaaagtccaggccgatgcgggtattcagggatttcgggcttccgcctgcaaggtatgtgataatgtcatgagacataaacgaggatataataccgtttgtcgctcctaacgaacctttgatcggttcatcggggtaacagttcagaagtccggccggcatgtttttttcataggtgacgccggattgataggattcaggcgtgagcagaggcccccattggccgctgaagctgccgacacccccggtcataaacgcgatattccgctccttacaatactgataaacccattcagaaatgttatggggtttgtcagcggcatttatgacgatatcaatttcgtacggatctaacacacgcaggtcctgcggctgtgtcatttcctgatggtaaagtgctgcgtccgcatggggattgatacccgcgatataatctctgcattctgagatctttaatttgcctacagaagattgagtatagacgaattgtctgttcaggttatgtactgatacggcatcgaaatcaatgagaataaaatgctgcatgcccgccgccaaaaggttttgaagaatgatcgttccgacgccccccagacccacgatcgctgccctgctgccgtctaatctgttttggatcagattggggttttggttgtatttctcaaaatggtacagctgcttttcagtgatgcagccttcacggccgttttgccatggctctattaaagcatccaatttcattaacgcatcgaaaaactggtttcccgcttcctctcccagaagatcagaaagctcttgtttttcacagccggtgatcagccgttcaaccgcctctttgatctcactcgtatgcgcaagcttaatcgcctttcgatattgaatgataatatgccccgtgtaggtcagcacctgcacgctgtctttaaacttccagcgcttacagtccgttgacatcatgacataccccctgaaagataataactccccaaaaaggggagtcacggctttactagcagcgatgcaccaagcttgctgtttctgtatcaagatcaagttcttcaatcttcatcagtacacaccccctttgccaataactagatattatcatcaatattggaaaaggacaagttattttttgaaaatttagaatttatatataaattgtgatatttcttccgctatcccggtttatcccggcagccggatgatgaacacggagccttttccctgctcacttttcacttcaattgttccgttatggctgtcgataatggtttttgtaatggcaagacccagccccgcgccgccggattgacgggatcgggaggtttccgccctgtaaaaccggtcaaacacatgaggcacatgctccggagcgattcccgttccgttatccgcaatcataagcatgattcctccgtctttctgcagggagacggtgatgacacccgtgtcttcatccgtatgctgcaccgcattgtaaaagagattgagaatggcctgcttcattttgtctttgtcaaaaacagcttctatcttttgatcaacaaagaactcgagtttccggtttctcgcaagcagcttcagctcagcctccatttccaaaatgacgtctcccaatgccccttttttcatttcaaagctcggctcccggtcaatcttcgcgagaaacaaaagatcctctatcagcttattcgccctgacggattccgcgtacatgctttgaagcgctttttctttctgctccggcttttccgccgctccgcgcattaaaatttcgataaagccgtgaatggaggtaagcggcgttctcagctcatgtgatgcgtctgatacaaaccgccggatgcgctccttcgcttctttttccgcctgaaacgcggtttcaatccgttccagcatctgattgatggagatgcccaatgactcaatttcggcctgcttcctatcaatcggcagccgtttatcgagactgccggcatgaatgtcacccatcatatgcacaatgcgggacagcggcttgagtgtgagccggatcaccggcaaaaaaacaaacagtccgataaccaaagccgcaaaggaaagtatcgcgaaaatgctgatctggcggaaaagcgaatcattcagaggctgggtcagcgtgctcatctgtacaactcccgcctgccttccgtcaacggaaatcgcctgaaacacgacgatgatttcctcacccgccttattgtgagccacctgatagtgaagcgccattgtatctgtcagcgcatcccgatacacgtttttcgggaaagaaggagcggctcccgcgtgcgggtcttctgataaaactgacatcttgtatgattgattgataaaagcaaccgtcaccccgggataaatcacattcggatgagccggtgtttcggaacgggcaggggttttgattgacctccatacgctttgatccattgaattgatatcactctgaatgctgatcgcctgattttcatacatcgtccgtctcataaacatgtactgtgtaccgccgatgaaacataacagcaaggtcaaaatcgccagtgacctgaacaggagctggaaccgcagggttctgtacagccgtttcatgccaggtccaccctgtacccggcgccccgaaccgtgcgaatcaccttgtgttctttgtccttcagcttttcgcgcaaagaacgaatgtatgtctcgacgatattgtcttccccgagaaccgttccgtgatgaagccccatcgttaaagaatcaatgagtgcagactcgccgtctgcactcagcagcttgatgcctttcaacttattcatgatgcagtctctccttagatgtatcagcctgtgtttatttttttcgcttccccttctattattcgcttttatctgaaacaaaacggaagctaagctgaattggtgaaagtaaacgctgaaaacggagccatctgcaaataagctgccggcagtttcatctgccgctattcagcagcaccagtctgtttcaatcacaaagttctaaggtcatgtctgcctttttctacatatatccattttcaactgaacgtgttgtgacccgcgttcagttcttttttatagcttctgaaaaaaggcataaaaaaaagcgcccctgaaaaaggacgtttaatatgacatgtttcattttcttaaattctgcattctaaaataattcttccttcacattcaccctcgatttcattcaatacgatgatcacatcagccgttttcatgtgtttcacctccctgcttcacaatagtataatattaacaaataaatcaataaaaaacagcccggatgtccgggctgcttttttatttctgtaatcgatctgcttctgtcagtttgacttccgctgtttttttctttcccgaacggtagaacgtgatgttcacacggtcgccgatctttttgcgatacaggcgctcacggagatccacaacgtcattgaccttatgtccgtcgaacccggtaatcacgtcgagctttttcaaacccgcttttccggccggtgaaaacgcgtcgacacccataatgaccgccccggttttaacgcctttcggaagtttcagcgtctggctccaatggtagctcgcaatatccgttaaggatttcatctcaataccgaggaaaggccgtcggacttctccgtatttttctaaatcctgaataacgggaatgacaagctttgacgggatggacaggccgattccttcaacggcggattcagcgatcttcattgagttgatgccgaccaccttgcccgaaatatccatcaaagcgccgccgctgttgccgggattaatcgcggcgtcggtctgcagcacttccgcattccaatccggatgtccgtcgccgtttgagtcaacgggcaccgctctttccgtgcctgaaatgatcccctgtgtcactgatcccgcaaattcaagtccgagcggatttccgatcgcaatgaccggttctccgactttgacttgatcagaattgccgaactgggcggccgatttgattttatcagacttcaccttcagtaccgcgagatccatcagacggtcgctcccgatcagctcagcaggcacgcgcgaaccatccttcaggctgatctcaatctcagtcgcaccttcaatgacatggtgattggttacgatataagaagtgtttccgttctttttgtaaatgacgcccgacccgcttcccgcttcgccgccctctccccaaatatcagtcttttggatattgagaacgccgactaccgaatccgatacacggctgaccatattcgtgacagcgtcattgacatttacgttgactgttttcacctgttcgctgccgagacgccggctggtgcttttgctgctgtctccatggtctccgcctgtccagtacggcatcaggaaagccatgagcgcggccccgacgatgacgccgatcagacttgatagaaagtatcctctcttgctgcggcggggctgttcggaggcgtactgttcatcatcgcgattataatccaccctatctcaaatcctttcaagagtactcgatttgcttatagtgtgggtcagatcgcggattaataatcatgattcatttggaaaaattacacggcgcacagcggcgtcggaattttcggatcggtatcaaataactgaaacgtttccccggcgacaaatcctttcgcagccaatgtctgctgcacggacattctcgccagttccttcatattgttgtcttggctcagatgcgccaaatagatgcgcgatgtgccgtcgccgatgacatcagtcatggcgagcgccgcatcttcattcgagacgtggccgacatcgcttaaaatccgccgcttaatgctccaagggtatctgcccatttgcagcatgccgacgtcatggttgctttcaaacacaaacacattggccgaacggatgatgcctttcattctgtcgctcacatatccggtgtccgtcatcagcgcgagctttctgccttggtagtggaaaacataaaacatcggctcggccgcgtcatgagagacgccgaatgactcaacatcaagcccgccgaaagactttacgctttccatcgggaacaaaaacttttgtccggtatcaagcttgccgatctgattctccatcgctttccacgtcttttcattggcgtagacgggtagaccgtactttctcgcaattacgccgagccctttaatatggtcgctgtgctcgtgagtgacaaagatgccgtcgacgtcgtctatcttgcggccgattctctccatcagcccgtccatcgctttaccgctcaggccggcatccaccagaaaagaatgctcctctgtctccagataaaacgcgtttccggtactcccgctcgcaagcacgctaaattgcaagcccattgtgtctcactccattatttattttgattgttatcaatgactgtgctttccaatgcattcacagtgtacgtttgctgtgtctttttcttcgtcccttttgacttatcttcaattgtaattctccataccggcgccagcacctgcgtacttgtcagcgggtattgggcaatatagccgaacttgacgcttttaacggcgcaattcgcttttaagtaattttgagaatacaataattcgaccgcatcaagctcaggaatcaggctctcggtctggattcgcttgaatgactccagcatggtctgctcgtaggatacgacctggtttttatcgttcagatgcagaatcacctgtccgatcgcatccgtggacgagtcaaaatcctgataaataaactgtccgtcatatgtctggtaaaaaatgatctgtttttgatccttgtcgactttccacagtttatatttttcaccgccggttactttagaactgacgagcgattccgcatcctcctgcggtttttgcttcgataaaccgaccggatcggtaaatttcattttcagcgttgtgaccttatgatcatccgccggcatttccattaacggcttttgatccttcaaagcatcaatatcttcagcggtaaataccttttggcccgccgtcagccggtagcccgtcgcggaatcagaagacaggttgccgaatgtgatatggtccatctccatgtctttttccacgtttgaatttttaatcacttcgtattcactgctcgagcgtttttcaaaaaactgatagccgagaaaaatatcgaggatgaggaaggcaatgatgaagatcgtttttgtcttattccactccattatcgtcctcctccttccccagcagatctttcgtaatcgggacgatcttcccgttgatcttcatactccagacgggttccagttcaacgagatcattcgttgaagaagagaccatttgataggacaggaagatctggtcgattttgttcacgtcgtatttatcctgctgctccagcagagacacaacctcattgccgttcatcatttttacgtcttttgttttaatcggattcggcccgagaacatagttcggccgcttgtagctgagaacctcgtcattggcccattgcagggtcaaaacaggtccggatccgaaaggcttagacgtgctgttgatcacaggcatttggtctttaaacatgtagaaactcagctgctggttatcactcacattgaaaaattgataatgatccgtccagcttcccgtatcctctaaatatttatagcttttcttaatcagctcacccgtttggtaagaagcgctttgtgccaaattccgatgctggaattgaatctgccgctgtgtcgaattgatttccagacggctgattccgtcagtcagcacattccgattgtaattcgggtcctctctgaccgtgctcggatcattaaaaagcgtctgcttaaacaggttcgtcttaatggtttcagtgataaattctttttccttcatattaaaccgcgcattcggcatgagaaattctttgctttttccgaccgaatagaggtggtataacggcatactcgactttttgctgtacagctcattcatcagattgcggtaattcgccgattccacagtcacttccaaaatcagctgcttgctgtacgagaccatgtaaatcttcttattcgtcttattctcattaaacggaataacaatatggtcaaatgagctgtattccattgacggatttgaccatttaaacatcgattggaagaaatcaatcggaatggtgtcattgaattgcagatcgagctttgccgaattgccgtttctgccgtaaagccaatttttaaaaccgagcttgtcgtattgatcggaaatatccttcatcccttttacttcccattgcggcaaatccgcccacaggtcattaaagagcgtctcatcatccactttataatgagagccgtttgtatgaataaacatatcccggggttttaccgtttgcgacactttttggctcgttttatcaattttatgcttttcccggacagtcgatttggttgaggccgtgccttctgaaaaattgggctggaatgtccaaattccccatgttaaaacaagactaatgacgaccagcactgacagtatgactgtttttatattttcacgcctcatcccaatcatcctcttgctcttctttatatggaagagtaaatgtaatcttcgttcctttgccttctacactgtcggcccaaatgtctccgccgtgcgcctgaaccatctcttttgcaatcgcaaggccgagcccggtgccgccgagttttctcgtgcgcgctttatccactctgtagaaacggtcaaagactttttccacatcttttttcggaatgccgataccttcatcttttacgctgatataaagcagctcttctttctcgttcacatcgactgagaaagtgacatgcccgccttccggtgagtatttcagtgcgttagaaatgatattatcgagaacctgcgtcactttatcctgatcaatctccacgtacagatttctgtccggaagctcgcggataaattcaacatgctgttctttcgtcatttcaaaacgatcgataatcagtgacataaagcggatcatatgaatccactcccgattaaactgataatctttgctgtcgaatttagaaagctgaagcaggtcgttcaccaatctgatcatgcgctcagtctcattttgggtcaccattaagaaacgcggagcgatatctttgttttcccacgcgccctctgcaagcgcctctaaatagcttcgcatggtcgtcagcggtgtccgcagctcatgagacacgttggcaacgaactctctgcgttcccgatcgagtttttcctgttcggtgacatcataaagaaccgcgattaaaccgtcgatttttccgtgctctctctgaataacggaaaaattcacccgcagtacagtcgtttcatcgtcacgttcgatctccagcagcattgaatcctgctgttctactaaatcctcaaatgtaaagttctcttttatgcccaataaagacgtaatcggcatctctaaagccgtttcacgtgaaacattcagcagctcaagcgcagggctgtttaaaagaataatagccccgttgcgattcgtagcgatgacaccgtccgtcatatacgcgataacggaagaaagctttcttctctccccttccgtcatggcttgggcatcttcaagctctctcgtcagatggttgaatgtcgttgcgagctgaccgatttcatcatgcccgtatttccgcacctttctggagaaattcccttttgccagttccatcgcctgcttacgcatatccgatagcggatgggtgatggtgcgggcgagaaatataccgagaagagccgtcagaacaagggctaagcctgttcctgaagcaagaatcgagttgacggttttcatctggttaaaggtatcttccatactggccacgacataaatcgcgccgacaacttcctgattctctgtgacgacaggttttgctgaaatcagcactctgtttttgcttttaggatcataatatttttttgaataggcctgttttgttgagaaaatccgtttaaaaatcgggtcagtcgtctgtttccccgctatttcctcgccataaggcctcgaagaaccgacgacctcatagcttttatcaacaaatgtaatctcccgtatttcattgtttttcgtaaaatcattcaaaatccgtttgacgtcatctttaatgacggtgctgtcattatctcctttatattcctgctcaatataataggatagattgtcaatccgctgatttaacgataattcataggacttgagaagagaattctccacctgtttcacaaagtacacgccgataatctgcatggcgatgataatgagaagcacatagatcagcgtgatcttaaactgaatcgaccgaaaaaaaccaaccttattcatcgccggttagtcctgttcaggatttctcaagtaataaccgacaccccgtcttgtgacgatccagttcggatggctcggattatcctcgattttctcacggagacggcgcactgttacatccaccgttctcacgtcaccgaaatagtcatagccccacacagtctgcaacagatgctcacgggtcatgacctgtccgatatgtttggctaagtaatgaagcaattcaaactcacgatgagtcagctcgatcgtttcttctctttttgatacgacataagcgtcagggaaaatgacgagagaaccgatatgaatgtcattagaagctgattcttcctcagccggcgcaaccgtaagctggcggcgcaggttcgctttgacgcgggccagaagctcacgcgtgctgaaaggcttcgtgacatagtcatccgctccgatttcaagcccgatgaccttgtcaatctccgagtcttttgccgtcagcataataatcggcatatcatattttttccggacttcccggcacacttcaactccgtctttattcggaagcataatatctaaaagaattaaatcaggctgaagctcctccaccatttccacggcttcgtttccatcgtacgcacaatgcacgtcatagccttcttttcttaaattaaactctaatatatctgcaatcggtttttcatcatcgactacaaggattttcttatccatcatcttgattttcctcctgccagaatgacttcatttcatctattgatgtttcatgatgatcacaattcgtatcgtgaaaaacgttccccgtctattataacggtttcaggtcaaaagataaaaaaattaaagagaacagcgcaaaaacgtattgaactgccatccttttgtcatgttttttattttcttttaaaaaataatatttttttgaaaccttaagaaaaaaaacgccgtctagtgtttgacgtcttcttctgggccggctgaaaagccggctctcccttttttataacaaaagaaaaaacgcacctactattgcagatgcgtttgggtaagtggctcgggacggaatcgaaccgccgacacacggattttcagtccgttgctctaccaactgagctaccgagccagatgtttcttttctatactataaagtaaagtaaaatggcggtccggacgggactcgaacccgcgacctcctgcgtgacaggcaggcattctaaccaactgaactaccggaccttacagtaatttgtccggagaaccgtatcgtggcggccctccgaggacaaataaggagttagcaataacgctaaagtaaatcaatgacccgtacgggattcgaacccgtgttaccgccgtgaaagggcggtgtcttaaccgcttgaccaacgggccataaaaagtggtgagccatgaaggactcgaaccttcgaccctctgattaaaagtcagatgctctaccaactgagctaatggctcttgatgtgtcggattatgtatcatagagcattgagacaaaagctttcttgcagtactctattgaagctgttccgtaacaacgagatttataatatcatagaacattcgaaagtggcaactacttttttgaaaaaaaatctattatttttttcctacataaaaaaacaagcctccgtgaccggaggcttgtttgctgcaaattcttagttagcgcggtatacactgcggatgacgttcgtttgtgaacggtcaggaccgacagagaaaatagaaagcggaatacctgtcagctgagatacgcgttccagataatggcgcgcattttcaggaagatcgcttaatgtttttgcgcctgtgatatcttccgtccagccaggcatttcttcatataccggttcacactctgcgagagctttcagacttgccgggaattcttcaatcacttcacctttgtagcggtaagcgacacagattttcaatgtttcaatgccagtcagcacatcgattgagttcagagaaagatctgtgattccgctgacacggcgggcatggcggacaacaacgctgtcaaaccagccgacacggcgcggacggcctgttgttgtgccgtattcgcgtccgacttcacggatttgatccccgatttcatctttcagctcagtcgggaaaggaccgtcaccgacacgggttgtgtacgctttagatacaccgacgacgtgctggatttttgtcggacctacgcctgaaccgatcgtcacccctccggcgaccgggttggatgaagtgacaaacgggtatgtcccttggtcaatatcaagcataaccccttgagcgccttcaaataaaacgcggcggccttcatccagcgcgtcattcagaacgacggatgtatcgcatacatactttttaatctgctggccgtattcataatactcatccagaatatcttcaattttgaagccttccgtttcatacattttttccagcagacggtttttctcttcaaggttccgttcaagcttttctgcaaacacgtcacgatctagcaggtctgcgatccggatgccgatccgcgccgctttgtccatataagcaggtccgatgccttttttcgttgtgccgatcttgttggcccctttgcgttcttcctctacttcatccagtttcagatggtatggaagaatgacgtgggctctgttgctgattctcaagttatccgtgctcacattgcgttcatgaagatacgcaagctccgttacgagcgctttcggatcaacaaccattccgttcccgatgacacacgctttttctttataaaaaattcctgatgggattaaatgaagcttgtacgtgacgccatcaaacttgatggtatgtcctgcattgtttccgccttgataacgtgcgatcacttctgcattttctgataggaaatctgtaattttaccttttccttcatcgccccactgcgtacctactacgactactgaagacatatatccgtgcacctccgttaacctttcaaaacgatatctcattcaaacaaattaagtgtatcagtgccgaaacagaaagtcaatcgtaaatccgaacattaaaatcttattattctatatttgttcgccttaaacctgattaaaagcgttttctctttcatttgctatctattactcccgaaactttcatactttaacacgaaaaagaacccatatcccgggttcttcagacagtcatttatattccgcttgtattcatcaggacgatccgccagccgtcaggatcttcgatggtcacgcctttttcttcccagtacgggttttcgggttctttctcctcatatcccatctgctttaatttcgtgctgatgcgaatgacctcctgctgatcagggatgtaaaagacaagcaggctgtcgccgtgcggaacgggcgccggctgagacgagccggtttcttcggtgaattctaagtgatattgcgtatgcggcaggccgaacatgacgccgctgtagccctcatgtccggaaaaactgccgaccctcttcaatccgaggccttcttcataaaacctgatgatttctttgagctgtccggtcggccgggcaatccggatttgcgccgcttgaaattgcggaaattcaattgtcatcatcatccctcccttaatgccattatataaaagcgctttctttttatcgactgccgaacagacggcattctctcattctttcggatgaaaaaaagcctcaagacattgcttgaggctttacgcacctgccggaacaccgccgtcatcaaagcgcctttccagatttacgaacttattgtattctttcacaaaagccagtgagacggtgcccaccgggccgttacgctgtttggcgataatgatttcgatgatgtttttgttttcggattctttatcatagtaatcatcacgatacaggaaggcgacgatgtcggcatcctgctcaatacttcccgactcacggatatctgacatcatcggacgtttatcctgccgctgctcaacaccccgggagagctgagacagggcgatgaccgggacttcgagctcccgcgccagcgcttttagcgcccgtgaaatttccgatacctcttgctgacggttgtcgctcgaacggccgcttccctgaatgagctgcaggtagtcaattaaaatcatgcccaatccgttctcctgcttcagccggcggcattttgaacggatttcgctgacgcggatgccgggggtgtcatctataaagataccgctgtttgacaggcttcccatcgccatcgtcagcttgccccaatcttcttccgtcagattacccgttctgagattttgggcgttaatattcccttcggcgcagagcatacgcatgacaagctgctcggcacccatctcaagactgaatatcgccacgctctcatccgttttggtggccacgttttgcgcaatatttaaggcaaacgccgttttccccacagacggacgggctgcgacaatgatcaaatcattccgctgaaaacccgccgtcatccggtcaagctcgataaagccggtcggaatcccggtaatatcgcctttccggttgtgaagctgctcaatgttgtcatatgtttgaacaagcacgtctttaatattttggaaggcgcccgaattttttcgctgcgcgacctccataatcgttttttccgcatcgcttaataaatcttcaacttcatcctcgcgcgtatacccgtcttgagcgatcgaggtcgccgttctgattaaacggcggagaatggatttttcctcaacgattttcgcgtaatattctatattagccgctgtcggaacggaattcgcgatgtccgtcaggtaagagacgcctcccacctcttctaacaaatcggtattcgcaagctctgacgttaccgtgaccaaatcaaccggttcaccgcggtctccgagcacgagcatggcattgtaaattttttgatgtgacattctgtagaaatcatccggaatcaacacttcagaagccagtgtcaacgcagacggctgtaaaaaaacagcacctaacacggcctgctcagcttctatgttttgcggcggcagccgatcattcagaaggtctgtcatgctaagcaccgtcctttccttaaaaaatatccaaatttcattttaccatttctcatgaaaaagaatagaaaaatatcactttccctgtatttgtcaggagagggttatgtgttttaccgttccgaatgccgggaaacaaataaataaatcgaaaccgggaggtaagaaggatgaaaacatatgcagtaacacccagtgttgatgcggacggatggtttgtgaaggtggaaaatgtggcgccgacggctctttgtacatcaaaggacgcggcgattgaaaaagcggagcagatggcgaaagagaacagcccggctaagcttgtcatttatgatcagcataaaaacattgaagaggaacgttccttttaagaaaagccttcgcccgtgcgagggcttttcttattcgatgaaacggatgtgcagcaccgtctgcgccatgagatcggccgttttttgatacagctcccattcttcaaaggcggcgaatactttcatcatgtcctgcaatgtctgtttcagtatgataaattcgtcaattgtccgcagttctgcggcttttttctgataatcagccagcttcagctgtaataacatcaatggcgattgcataaaaaacctcccccattctgttataaagccccgcttttcaaacctccattcctttgtcatatcctcttacgatagatttctgattttagtacaataaagaaacggaaggagtgatcacatgaaaccgctgcaaatttccgccgaaacggcgcaaaagctcgcagaatcactgaatatgccgcttgagagaatcatgcacatgcctcagcacattctgcttgccaaattagctgaaatccaaaaagagaacgatcacaaataaaggctgctctctcatatatatgtgcgggaggcggaagcgatggctttccgcctcttttttccatgaagaaaatttcggtaaaaccgtctcacagctgaaaaaacttgttgacgaaggaaaagtgaactatttcttattatccggaaacaattcaggcaacacaaagcttgtctcatggattaaaaagaacggcacaaaaatctcagctgaccgatacagcaccggaaaaacaggctcagcccgatgaggaatgacaggcggcccgggcggacaaagtcagcagactctgtatgagatgaaaaaacagctcggaaagaggctggatagttaaacaccggcctctttattttgctcttgaagcacctgccatgcggcgccggtatcattcagaaaaatgattgataaatcctttctatttttgaaaccatcagttcctgacgcagatgccggccggcataggagcgcgcttcttttccaagccgttccctgagagactgatccgtaatcagctttacgagggcatcagcaagttcgcggctgttgccgggctgacagataagccctgtgtcctcgtgccggatcatctcagggattcctccgcagtcagttgcgacaatggcttgacctgagaacatcgcttcgatgatcgctatggggaaattatcattcaatgtcggcaggacaaatatagatgattcagccaaaagcgccggcacatcatgtcgttttccgaggaaaaacacgtttgagaggcccagtttccgtctcttctcttccagaaaccctctcatgtttccgtccccgatgatccatatatccactccggataaatggtgccggatgcgggcgagagcgtccagcagcacatcatgtccttttcgctcggtcagacgggaaacgcacgcaatcacgaccttttcagcacgttttggctcgggtgcaacccggatgtcaatgccggtatgaacagtcgtcagctgagcctccttcgctccgtactccagcaagggctcgtgaaaggagtcgctgattgtaatgattttatccgaagcccgaataccctgcctttctatttcactgaaatatgcctcttctattgaacccttttggattttatgaaacttcatccggcttttcgtgaaatgtccgtgcggcgtaaaaaaaagcggatgccgatacgtttgattaaggtatcccagcaaaaatgccgcaaataaatcctgcgcgtgaaacaggtcatattgttctaagtccttctccttcaaaaatctttgaaagacatgtaaatagctgagattcttcacaaacttttcgtttgcggccccgtatctgccaacaagaaacgctctgatctcgtcagcggcccgcgggatatcttcctgaaaaaaagttggcggcatttggagcggcgagatgacatccgcctggtgaccgatgcgctcaaaacccgtcttaattgacgtgatataactcgccagtcctccgacattcgggtaacggagaaaggttgcgtacagaatacgcaatggcttttttcgtttgggggagctttttccttccgcacagaacgaatacagcatctccggctcactttgatgttcgatcccgtaaaattgatccatgacgcgcaataaggttagaggcaccagaccgttcggcttgccgatctctcctttcaaatccgctccccctctcttaaacttataatcctaattcccgtccccattttgacactttgtcaacatgatacggcagcagttctcctccccgattgtcgaagattctccgcaattgggtatgaagccctttctcaagtgttctctgcaaataagccattttataaagcgtcataggaggggtctgaaaatgaatgccccgctttttcatttctttcgtatacacttttacgcaatacgtccgaatatcttctgcgtgccggctccagtcttttctgaagccgagcagaatttcgaccagcaccgtcatatcaaaccaaaccggcgcgtactttgcggattcccaatcgatgaattgaatatcccacggttcatgtccggacgcatcgtgggtgcagatattctgcatatgaagatcaccgtgtgtgatggctgagccgttttggaccaattcagggaaaaaacccggctcctcctgctccagcaagtttgtgatttgccgataatgaggcttcacgatatcctttgtgcgctcatctttaagagctctatccaataattccgctgtctttttgatctgctttttacgcccttttctcatggtttccgattcgtatagcggcagccacgaccgccatttaccgtcagaaacagccttgttttcaaaggtgcggctgtgcagttctgcgacagacggaataatatacttgaaatgcttcggatgaaatgtaagctgtcctctgatctggctgacaaactccataaatatccacgtttcatggtcactttcctctataagatagatgtccggcagcaaatcccctaaaacagaacgggctttcccgtatatattaatctcgaccttgtttttttcacgtgaagatttatacaccttcaatatcagcggaacaattccggattttttctttacaaacagtttataaatggcgcttctgtctgttgatttcaggcatgtgatgtcatccggattcaccgcggccctttcaccgaacgaatacgacagtttttcgtcaattctcagtttttgaaatgcgtcatacaaaagatccttttcatacatgccgatcttccttccgcttccgtttccagctgtttttgagatgagaccaagtgtttctgataaatggcatcgggtcattccaagcaaacagagcgtactctttttttcctttaaatcctttccaaaaatcccggaacgtcatttctcctctttttcgtttcttcaaaaacgttaagaagtaacgcacctcataaatccagttgattccgtctttttgttcgagctggggcttcacatgttgtccggtcaaatacagatagtacatgtaaacgaaatgaatgcctgccggttctgtcaggctatggctgagccaaaagcgcggattaatttcgataaacttataaacattgtcccgggggtcctttttaaattctgccatgcctactcccttcagctgaatcgcttcaaaaaacggcagggtcttctcgattaaatcaggaagccgtttgctgacgacgtgggccccgcgccaaaatcagcagggaattgatggttcttttgcagagagaataagcccattaatttcatttggtcatcataaaaagtggcgactttataaaaacactggttgtctccggggatgatctcctgcacgagcagttctccattttctctgtaggagctgaactccttgcgcaattgtgcggcatccttcattacaattgcttttttgtttactttttttctgtattcatggccggccaccggttttaaaatacacgggaagtcaatattggcgatggcctcttccagctcatcccggttgttcggaaaaaaggttttcgggcaggggatgttatgcttgaccgctaattcatatgctttgcttttatctaagaccgtttctaacagagagcggctcgggagcaaaaataaaaaaaaaccggctaatgtctcgcggaatttagatataaatcccgcataatcatcagaacctgcatacagaaccggctttgcttggaatcgcttcccgaaatcagtcaggaatgtcagcagttcttcctcttgtgttaaagggctgggacatatcccgcaatctgccaatcttgattttccgatacgataaggtccctccgtgtcaaatgcgtaaacatcgattcctcttcgggccaggctgcgaatgatcccaatcccgtttgcactgaaatctagtacaacggctgcatgttcatgtttcatgatctccctccgagctgttggtattttgataaatcgattcgatattttttatcatcgtctcactgctcaaatatttctccgcgtaggcctttgcgtttgaagcagctatcttccgcgcagatttgttagtgataaaaaacgctaaagcccgggcaagaacctttgcatttcccggctcgacaataagccccgttttgttatggcggatcagatccggaatacccccgcaatcggtcgcgatgatagccgagccgctgaacatcgcttcaataatcgaaataggcagactgtcattaacggtcggcagtacgaatatgtccgtcatattcaaaatagcgggaacatcatctctttttcctaaaaaggaaaccatagatagattcagttttcgagcctgttcctctaaggcgctcctcatctctccgtcgcccgcgatcagcacttcaacatgctcaagtacatcagacggaattcgtgaaagtgcgtcaagcaaatgattatgtccttttctcgggcctaatcttgcaatacacgagatgatgatcttatttttcggcagcgggatttttcttttcccgcctgtttttgcatcgtaatcgattcctgtgatcaccgttgtcatgtcttcctgttcggctccgagcttcatgagcgggctgcggaacgtatcgctgataataatcaggcgatctgcgtattcaatggctttcatctctagttttttataataaaactcttctatcgatccttttttaaagatgtgaaatttaagtctgttgaaagtaaacatgccatgcggtgtgaaaaataaaggtttcttatagatttgattgaatctgcctaatatattggctgtaaataaatcttgagcatgaaacacatcatatctttccaaatgaatcttttgaagcatttgctcgtatataaacatcagccgattatttttcaaaatatgattgttataatccccatatctgtccttaaagaaatcttttaacttcggaacaacagccgcccgcagttcttttacctgtgcggacggaaacagattaggggagatgacatccaccttatgacccctcttcttcaggccttcactaagcgttttaatatagtttgataaaccgcccgtgtgcgggtagtcccaaaacgtggcaatcaaaatggataacttcttttttttcctgtataaccgcggaatatgatgttcatgtttcaactgtgtctttactgccgcctttttttgagggcgcgttttgaccccgtagtagcggtcaagcgtctggaccatatacggatacgggacggaaaatgtcttgatcatttccagatcctccgcacgacttcaaaagcttcggcgtattccacacccgccgtcatccctctgacttttcctaaatgtttaacgccttcatatgaacggggatgagggtaatccctcatttctacgtcatagtggtgaagcgccgcgagtttagcatccattgtgtctgtgatgttaacgaagtaattaggtttgaagagtttatcagccgtattcctctcccactcgcttgaagatagcgtttcgaacgtaagcagttcgataggtttttgattcggaagcggtctggcggctgttaaaactgcttggaatgttctctggtggtccatattgatatcgccgtaatgatgtgtaaagattttatcaggctgatagacgcgaatgagctgctctaattctttgacaagcttatgaagagggatacattccagctctaaattcgtatgctccaaaaagatgactttctcaattccaagctcttgattcgcgcgttcgcctaattgtttaatatgatgagcttcttcttttcttcctaatgccgtaataatggaaatcactttatatccttcattgatcagccgttttatggtgcccgctgctcccaatagttcatcatcgggatgagcgccgataaccataatgtattctgccattttttccacactccaccaaacaaatgttacaaatatcatatgacgaccctaaaaaaaggaaacttacatgtgcggattttcagaaacttacatgtgcggctgccattccaggtaacgtgacggatttaatttttttatagtattcaaaaactcatccgccaagccgtatttgtccagtccttttaatagttttacgggaaaccgggtaatagcggaaaaagctcttttatggtcgatgactttaagatttccgtgttcattgatcagaatgtgcctgatttcggcatcccatctggtaaaaccgattctttttaattcatccagcatatttaaaatatcagcagtcattttgacggacagggatttttcttttctgatatggcgggcaagagaggtgccttggacgtattccatcacaatataacgatctccgtattcatacagtcttggaatcaccggggaaccttgtccggtctttaaagccgccaattccttcttgcatgtccctttttcaaagaagtattttatgcatttgttgtgtgttaagcggtagacttccccgtcttttccgtctccgatcagcggataatgctccagcgcctttttattctccggattattaaaatatgtttcagaaaaaaatcgtttcataccgacacatccttcgttatgatgtaatataatatgcaatctggtaacgatcggaaatgaaacaatctcatcattttcttgcgctgcgccgtctgctgacatgaaaaaaacccgccggatcggcgggtttttcattgtgtattacgcttcttcttttacgtgaaccttcagcacagcctgaacttcagggtgcagctttacaggaacgtttgtatatcccagtgtgcggataccgtcttggagctccagtttccgtttatccactttaatcttatgcgttttttgcagcgcttctgcaatctgcttgcttgtgacagacccgaaaaggcggccgccttcaccggatttggcactcagctcaacagtcagctgttcaagcgtttctttcaaatctttcgctctttcaagctcggcaatcgcttcttttttctctttttctttctgtcctttcaatgcgctgatgtttgtcgcatttgcttcgacagcgaggccttttttaatgagaaagttatgtgcataaccgtctgctacgtttttcatttcgcctttttttcctttaccttttacatcttgtaagaaaataaccttcatctctgaacgcctccctcaaaatattcatcaatggcttccttcagccggacgagcgcttctgagacagaaatgcccgataactgggttgccgcattggttaaatgccctccgccatccagcgcctccataataatctgcacattgacctcgcccagcgatctcgcactgatgcacaccgtatgctcatcccgtctggctaccgcaaatgaagcttccacttcactcatcgataagagggaatcagccgcctgcgcaatcagcacctggtcaaagtactcctcttcgttctcaggaagagaagcaatcgcgatatgttctttataaagagctgtatgctggatcagtttcgcccgcttgatataagaaccgacggattctttgagaactttctgcaccagaaccgtatctgcgcctttcgctctcaaataagaagcggcgtcgaacgtccgcgagcccgtgcgaagggaaaaactcttcgtatccactattataccagctaacagggccgtcgcttcaatcatattgattttgagccgcttcggctggtattcaagcagctccgtcacgagttctgcggtggatgaagcgtatggctccatataaacgagcagcgggtctttaataaattcctcgcctctgcggtggtggtcaatcacaacgatgtgctcgattttgttcatgagacgctcttccatcacaagggacggtttatgtgtatcaacgacgacaagcagcgtgtcgtcatttgaaatctccatcgcctcttccggtgtgatgaaccgcgaccacagctcttcatattttttaatttcttcaatcaggcgctgaacgcttgatccgatctggttcggatcaatgacgatgtagccttctttgccgttggcctgcgccaccttcaatattccgattgcggctccgactgcgtccatatcaggaaatttgtgccccatgataatgacattgctgctttctgagacaatctccttgagcgcgtgagaaatcacccgggcgcgcacccttgtgcgtttctccatcggatttgttttgccgccgtaaaatttcaccttgccgttcggcattttgatggccacttggtcgcctccgcggccgagagccaaatcgaggctggactgcgccagatctccaagctccttcaaggaagaaaccgatgcgccgatcccgatgctgagggtcaaagatacagtgtgaacggatgttttttcacggatttcatccaaaatcgaaaatttcgcgttttcaagctccgttaaaatgtgttcatttaacaccgcgataaaccgctccgaggacgtccgtttcaggaaaatgccgtactcctgcgcccacgcatttaataatgaggtgacctggctgttcatcgtgcttctcgtttggtcatccagcccctgtgtgacgtcatcatagttatctaaaaagatatatgccagcacggttctctcattttcatactgcttttcaatctgaatctgttctgtcacatcaaagaaatagagcagccgctcatctcttttaatcactactttaaacttccgctcattcaaggtgatcgtttccgaatcgacctcctgcttgatcagcggcacgacggcctcgcatgtgtcatacagcgagcgcccgacgagcgtactttcattaaaacaggaagacaaaaacggattcgcccactcaatgtaatattgatcattaaacagcataatcccgataggcatttccattaatgcctcttcgcctacttttttcaatctatacgataacgtggagatataatcgtcaatttcttttctgatcagagaatccgcacgcttaatgaaaaacaggatcacggcgagcagcacaacgccgatggctcctatcagccagttaaagtaaatgctgatgaggattatgatgattgacaatgcaatcaatgcatagatgggataccgaaacaacggtttttcataaaaactaggcatttctatcaactccccacctgtaagtcacactcaatttcgcgtcaccttatttcttatgttaaagcctatgtcaatgatgcctaagaggagatacacggacaagatgagcggaaaaagcacacccagcacaattgctaaaacaggaacggctttcggcatctccatttcgcggcaatagaaaaaaataaacgctaacccttgaatacaaatcagcaagctgagaataaatcccccattcaatgaaaccgaatacagcatatgccctttttctaaaggcagaaaccctaatatcgtcacaataaaatacagaatgacaacgctttgcgggagtttgagctctctaaaaggcttcatcttcggaagatcaggggaaaatcgccgtaaaagcggccttgccatagcataactgaggaaagaaaaaacgatgccggtcaatacgagcactgtcggaaaaagatattgaaccgtgctcagctgactttccatcagcttgatctgcttcccgaactgatctccgtaaccgagctgctttgacatggtttctgctaaagacatcgactcccgaagctgggacatggtggtatcgatcacattcatattaagaaacacgatgctgaccacaaaaaaaacgacgccgcacagcacatacgccatagcgccggcagcaaccgcatagccgggctgtttctttttaaaataatatcccatggcgattcccgtacaggccgccgtaaaagcgcctgtaagcccggtaaacgaacctacaataaagctgacaggaaggctggcaagccccatccataccccgggcttcagaccgtgccgaatggtgtaaagaatgatcggcagcggcaaagcaaagagaagaattgcccccagtaaagggaggtacacgaccaaaagggaaatgattgcaaaaatactgatcaaaatggcgccttctattagagcccttgtatttttcacttactcacctcaaaccttgtatcattcgaacatacgaatagaaaagagcagcttagacgactgctcttttgacgccgcaatgtctctttcaagacctgaattttccataaactctccaaaatacacgtatatattttaacataagtcgaaatcgcaagtaaaatgagcgcggacagccgcaatgttccatgtgaaacatgaaaacagacaaacggacatccccgtgaaagaatgcccgttgtatcagtgatcctgatcatccataaaaccagaagtttctctgtttttctttttggtttttcgtacatataacaagacgataacgataagtaagagagtggtcgcctgtaaaaccccgctgctgaaaaggaagaagttctttatcatgtcccacatatagtttcacctctatttcgtatttcctttacattgagtttccctttctggaaacttcaaaacatcaggaacaacatcgggaccggggcatatgctgaaagtgaaaatgaaggataaaggagattcttacactatgaccgagcggagaacattagcatggcatgaaacgttagaactgcatgagttagtggctttccaggcaaacggacttgtgaaattaaaaagaacagagcgggacgtaagcgatgccagattaaaacagctttaccgattttccatccattcgctggaacaaaatctgcgtgaactgcttcctttcttccctgaagctcccgcttttcgtgaggatgaaacagaagagcgcgctgattccgcgttttacagcggcggtctgctgagcatggccaaaacgtctgtgcgcaattacgccggagccattacagagacggccacaccccaattgagacacgttttcgtcaagcacttaaacgcggccatcaagtggcatcaaatggtctttgagtatatggaagaacgcggtcaatatccggcttacaacctgagcgaattgctgaagaatgatgtgcgcaacgccagaaaagccatcgcgatgaaataaaaaaaagcagcaaggaatttaatcctttgctgcttcttatttttgagcggactgatcttgaggcgacgttttttcccggtatgtctcgagaaactcccggttggcatctccccatttcttcatttgcaaaacgatcggttccagcgacctgccgaattcggtaagagaatactccacctttggaggcacctgctgatatacctcgcgatgcacgatgccgtccgcctcaagctcgcgaagctgaagcgtcagcatacgctgcgtaatgctggggcaaatgcgccgaaactcattaaaccgcttttttccgccgatcatatgataaaacaaaatacccttccactttccgccgataacggaaagcgtcagttcaaccggacaaccttctttattcggatatatgttcatttttcatcctccatagtaccttttttgatactatatgctgattagcatctgacttacccagtattttactcgcaatcctcctcaccgctcaacaaaaatgcttctttttcacatcaatttttaaggttttgaagattacaccctccgcaagacgtgttaaactataaaaagattgtttacactacaaaaaaggacaaggagttattatggaaaaaattcttattttcggacatcaaaacccagacacagataccatttgctctgccattgcctacgctgatctaaaaaataaactcggcttcaatgctgagcccgtccgccttggacaagtcaacggcgaaacacaatacgcgcttgattatttcaagcaggaaagcccgcgtttggtggaaacagccgcaaacgaagtaaacggcgtcatccttgttgaccacaatgaacgccagcaaagcatcaaagatatcgaagacgttcaggttcttgaagtgatcgaccaccaccgtatcgccaacttcgaaacagcggaacctctttactaccgtgctgagccggtcggctgtacggctacgatcttaaacaaaatgtacaaagaaaataacgtgaaaatcgagaaagaaattgcgggcctcatgctgtcagcaatcatttccgactctctgttatttaaatctccgacttgcacggagcaagatatcgcagcggcaaaagagcttgctgaaattgccggcgtagatgcggaagagtacggcttaaacatgctgaaagcgggcgccgacttaagcaaaaaaactgtggaagaactgatttctcttgatgcgaaagagttcacgctcggcagcaaaaaagtcgaaatcgcccaagtcaacacagttgatattgaagatgtcaaaaagcggcagccggaattagaagcggctctttcaaaagtaattgccgagaagaaccttgacctgttccttctcgtgattacggatattctggaaaatgattcccttgcgcttgccatcggtgatcaagcgtcaaaagtggaaaaagcattcaacgtgacgttagaaaacaacacggcccttttaaaaggcgtcgtatccagaaagaaacaagtcgttcctgttttaacagacgcgattgcagaataaccaaaacaccccggcaaccagccggggtgttttttttacagctcgttcatcagacggccgtttcgtaagcgcttactctaaaattattttgacgcctattaatatacaatatataatatatcacatgtaaggcgttcatttttctaattattgtaagttgctgtcgcaacatcagaatcgggggtgtctatcctggaaaaacacgctgctctttcttattcacgaacaacaggcatttggcttgtgcttacaggagctatcttatggggggtctcgggaacggttgcccagtatctgttccagcaccgccattttaatacagaatggctgacttcggtgcgccttctggtgtcaggggcgcttctgctcggaatcgcgtaccgcaaagaaaaaggacggatatgggctgtttggaaagacagacgggacagaattccccttcttttattcgggattttcggaatgttaggtgttcaatacacctacttcgcggcaattgagcatggcaacgcggcaacagctaccgttcttcagtatttaggaccggcgatcattacatgctttttagcgattcgcgcaaagagaattccttcaggaaaagagctgctcgccgtcttattggcggttgccggcacattcattttggtcacgcacgggaatgtcggaagcctgtccatatccggtctggccgtcttttggggaatcagttcggcgtttgcactggcgttttacacccttcagccgcatcgtctgctgaagaaatggggatccgccattgttgtaggatggggcatgctgatcggcggagccgccctcagcttgatccgcccgccctggacatttgaaggcgagtggtcctttcctgcatatgccgcgattgtgtttatcatcattttcggaacgctcatcgctttttattgctacttggaaagcctgaaatatctgagtgcctctgaaaccagcctgctcgcctgtgcagagccgctgtcggcagcttttttaactgttatctggctgcatgttcccttcggaatatcagaatggctgggtactttgctgattttaaccaccatcgctttattatctatcaagaaaaaataacctctcttttttagagaggttttttcctagggccagagcacccttaggctcaattacccatatattaaaaggccttttttcattttactatcatccaaaagaggaaaatagaccagttgtcaatagaatcagagtctaatagaatgatgtcgacaagtaaatcatgcaggattgttactgataaagcaggcaagacctaaaatgtgttaagggcaaagtgtattctttggcgtcaccccatacatattttaggtctttttttctgtaacaaacctgtcatccatgaatgcaggaggatcgaatcggcagatcgcaaaaaaaggtacatacaaaaggagacatgaacatgaacatcaaaaaatttgcaaaacgagccacagttctaacttttacgactgcacttctggcagggggagcgactcaagccttcgcgaaagaaaatacccaaaaaccttacaaagaaacgtacggcgtctctcatatcacacgccatgatatgctgcagatccctaaacagcagcaaagtgaaaaataccaagtgcctcaattcgacccatcaacaattaaaaatatcgagtccgcgaaaggactggatgtgtgggacagctggccgctccaaaacgctgacggaacagtagctgaatacaacggctatcacgtcgtgtttgctcttgccggaagcccgaaagacgctgatgacacatccatctacatgttttatcaaaaagtcggcgacaactcgatcgacagctggaaaaacgcgggccgtgtctttaaagacagcgataagttcgacgccaacgatgaaatcctgaaagaacagacacaagaatggtccggttctgcaacctttacatctgacggaaaaatccgtttattctacactgacttttccggtaaacattacggcaaacaaagcctgacaacggcgcaggtaaatgtgtcaaaatctgatgacacgctcaagatcaacggagttgaagatcataaaacgatttttgacggcgacggaaaaacatatcaaaacgttcagcagtttatcgatgaagggaactatacatccggcgacaaccatacgctgagagaccctcactacgttgaagacaaaggacataaataccttgtattcgaagccaacacgggaacagaaaacggataccaaggcgaagaatctttatttaacaaagcgtactacggcggcagcacaaacttcttccgtaaagaaagtcagaagcttcagcaaagcgctaaaaaacgcgatgctgaattagcgaacggcgccctcggtatggtagagttaaacgatgattacacattgaaaaaagtcatgaagccgctgatcacttcaaacacggtaactgatgaaatcgagcgcgcgaatgttttcaaaatgaacggcaaatggtacctgttcactgattcacgcggttcaaaaatgacgatcgacggtattaactcaaacgatatttacatgcttggttatgtatcaaactctttaacaggtccttacaagccgctgaacaaaactggtcttgtcctgcaaatgggtcttgatcctaacgacgtaacgttcacttactctcacttcgcagtgccgcaagccaaaggcaacaatgtcgtgatcacaagctacatgacaaacagaggcttctttgaggataaaaaggcgacatttgcgccaagcttcttaatgaacatcaaaggcaagaaaacatccgttgttaaaaacagcatccttgaacaaggacagcttacggttaacaactaataacaacaaaaagaaaatgccgatacttcattggcattttcttttatttctcaataagatggtgaattcaatcatggcacgaaaatggcccgttgtaatattgatctttttgggtgcgttcctgtttgtcggcttactgccgaacaaaaaccacaattcctctgacacaaacaacacggagcataagaaggattaccgggcggcgtatcattttacgactccggacaaatggaaaaacgaccctcaaaagcctatttttttcgaggggaaatatcattactactatctttataatcgggattacccgaacggcaacggcacagaatggcggcacgccgtatcaaaggacttggtgcactggacggacgaaggcacggctattccgaaatacaccaacgaaaacggcgatatctggtccggttctgtcgtcattgataaacacaacaccgcgggcttcggcaaaaacgcgctggtcgccgtcacaacgcagccgacagccaaaacaaaagcccaggaacaatatttatggtacagcacggataaaggaaaaacgtttacttcctatagtgatcagcccgttatgaaaaacccgggaactaaggatttccgggacccgaaagtgatctgggatgaacaggatgacaaatgggtgatggccatggccgaaggagaaaaaatcggtttttatgaatcacccgatttaaaaaattggaaatacacgggcggttttatcactcagcagatcggcctcatcgaatgccccgacctttatatgatgcgtgcagatgacggcacagccaagtgggttctgggcgcaagcgcaaacggcaaacccgcaggcaaaccgaatacgtacgcgtattggaccggaaactttgacgggaaggaatttaccgccgatcaagaagaaccgcaatggcttgattacggctttgactggtacggcggcgtcacatttgaagacggtaatagcgaagatccgctgacaaaacgctatgcgctggcatggatgaacaattgggattatccgaatgaaacaccgacactaaaaaacggctttaacggcacggattctatcgtccgtgaaatccgtcttcagcagcaggacggcggcacatacagccttgtgtcagagccggttgaagcattgaaccaattaacttcttcaactgacagcatagaacacaaacaggtgaacggttcagagacactgccgatcaaaggtgatacatatcagcttgatatggatatcgcttggtcagatatcaaaaatgcaggcgtcagactcagagaatcagcagaccaaagccggcatattgatgtcggtatttcagcagaagacggttgtgcctatgtgaacagatcgtttacagaccagcctgataaaaccggtgcatacaccgaaagcaaagccccatttgacggaaacaaagggcgcgttcatctgaaaattctcgtggataaaacaagtattgaagtatttgcagacgacggaaaaaccgttttgacaaatgaagtgttcccaaaacacgaagatcagggaatcacgctcttttctgaaggcggctccgctgactttcagcatattgagatgaagcatctcggttcgattcattcttagacgtccctcttcatttctaaccggcgcccggactgtggtaaaatgcaaatatgtatactacgattcatgaggtgttccattggataatcaaaacaaagaacctgtgctgaaaagaaccatcatgcgggacgaagtgtatcgcacactcagaaactggatcataacgggcaagctcaaaccggaaacaaagttaaaggacaaggatttgtcggaaacattgggaatcagccgcaccccgatacgggaagccttattgcggctggaagatgacggcttggtgataacaaaagcgaacagatggacacttgtcgctccgattgagttaaaagaagcggaaaacttgtattccatcgtctggacgcttgagaaactcgcattgcagcaagccctcccgcgtatggacgatgccgtgattcaagaattgaaacagctgaatgaaaatcttcttcaaacgatgaaagacggcgataaaatggccgttctggaagcggataatgcatttcaccatcgcatcattctgcttgcggacaacgctgaacttcacaaattgctagtaagcctgaaagtcaaaattcagagactggaaatccgctatttcagtgaaaacggcgctttaaacagatcatataatgaacactctgatatcattcacgcattagaacagcaagatgccgccgctgcttttacagcgcttgaagcgaattggaaaaacagtttagaacggctgcaaaacatggcatagcaaacgaaaaagccaaatcactcatatgatttggcttttttacggatatcacaagacagccgcgttgcctgtcttgtttactttttgtttatatataaataaataccgtaatccgtcggcacagaagcataccccatctgtctgagcatggctgttatattcccgcgatgatacgttccgtggttcacaacatggaggatcatatcggccgctgcggttttcatgatgtcacctgacggatgctctatttcaagggggaggctgatattttcctccttctgcaaaaatagttgataccggtctgataatttcaaaaatagatcttccagctcttctatctctttagacaagatgtcctctttttgctgttcagctgatttcagcgtatcctccagacgctctccggagaacacatcaaaccaccccttatccgacagatacacatgagtcaatacaccggctatcgacggaaagacactttgaatctccttacggtacacatcctccggaagctctttaagccgggtgaatatttgctgatttgcccaaagatgataatcatacaattgcagtgccagatgtcccacattaccctctcctctctcgatatagaacgtacgttcctaattatactacactacatgccgctctgtaccattttcttcattcgcagctgagaaaatccgataaaagccgaaattaataagagaaggcctgcgccaatataaataaaccgcacgccgaatacatccgagataatccccgttccgataatggaaaacataaaaatgaactgaactaaagctgatctcgccgctaatatattgacccgtgtcttttcggtcgtgatattttgaagtaatgtttcctgcgtgagatctcgtaatacacaagccggccccatacacagcaccagaaaaagggccgtaacggcgcttgtgatcagcccgtaaataaacgtgaacattccatatgccaaggctcccgtcagcataagcggaatgagatgatgctgaagcttaccggataacttatagatgatcagtccgccgatcatcgtccctgcataatagactccgttgacatacccccaccaagcctctcctttatgaaggacgtcatgcacataagttaaggacacagacccgatccatatcatgcctgcccacgattcgatcacatccatcacaatgagaaccttgagctgtttttgctgaaataaatacacccagccgcttgccgcatctgcaaaaagggaacgttccctgactgctgccggcgcacacatgcgtacttgaagaaacagaatgatgcccaacaccgaagaaaccaataacatgacagtgacgatcattgtatcgctctctcccaggaacgctatgatgacgccgcccagagaccaccccgcaaactgaacggtctgatccgccgccgataataaactgttcgctttcgcccttcgatcaggaggaatgatttccccaatcagcgcgctttttatcggagcaaaccatccgttgcaaaaagaaatgcctccgatcagacaaaacagcagaaaaaagaatgcggatgaaccggtttggatgacaaaaaacaaacagactaacagtgtgatctgtatcaattgagaactgattaacaaagaacgaagcgtgaaccgaccggtgaccagcggcaaaacggcgctgcccaatacgcggcatacaatgctgacgagcgtcataagagaggccatcgccgtcgaaccggtttttgtaaacaaaaacaagatgacggccatcgtataaagtgaaaaccccaagttgatagcggtctggctgtataaaatagcgtaatacgctctcttcatattcatcctctgcaaccccactccctgattatgtaaatcataccatatttaccgatcagctttttttaaaaaaacagattgacatggagtccactccatctattaggctttattagcagatagaagactttcagcaaataacaattaagaaggggtgacagctgatttgacatccccaatctatagtgatgtatataagaaatgattttcaaaacagaataaaaaaagagggcttcctttccggaagccctcactcactccgtctgctacgccaataaaagaaaaataagcgctaaaacagccggaagtccttgttttacgataattgatttgtttgaagtaaagcctccgaaaatggccgcgatgaccacacagatgacgaaaaacatttgaatcatatggccaatcggatcagctccgaggatcagtccccaaatgaggccggcagccagaaatccattatacagaccttgatttgcaaacatgaccgccacattccgatcgccttctaaatgcttcggcaatttgaaagaccgcttggcagccttcgaattgataaaaaacatttcaagtatcatgataaatatatgttctaaagctacaattccgacgaaaacagccgcaattatgtccactgtccctctcctctcagcttcacttcaaccttatttccattgtgcgattgtttcgataggaagacggtaggaagcatatccttcgtctgccgcttttccgattgataacagcatgaccggtacataacgctctttatccattccgaaaacctcggcaatcttttctttatcatagccgccgatcgggtttgtatcatagccgtgcgcgcgtgccgtaagcatcagctgcatggaaacaagacctccgtcgatcagaatcgtttcacggttcacttgctccggcagtttttcaaaatgcgccgtcaacgcagcgatttgtctgtcttttacttcctgcggcatgtagcccagctcgaccgcttttgaataaatttcttctaaatagtcatcactgttcatatctgcgaaaaccgcgatcaccgcagatgatgtgctgacctgtgtttggttaaagctggcaagcggcgcgagtttttcttttccttcagggctgtcaatgacgaggaaacgccatggctgcgcgttaactgaagacggcgctgtcgttgcttcttccaatatttgagtcatttcttctttgctgatttttacagccggatcgtaattccgaatggaacggcggcctttcataatgtccataaaatcgtttgttttcagttctgttttcatgtgtaatacactcctatgctttcatattttctatattattctgcatctgcgacaatacgttttttaacatactgcgttcttcctcgctgacaccggcaagcatttcctttatgaaacgctccttctcctttttggaagcctcaattctctcccgcccctgatcagtaagccggacaagtataattcggttgtcctcaggcttccgccttcttgtgaccatttctttggcttcaagctgtttcaagtgtcttgtcacagctgcgccgtcaatattcacctttttctgaagatcgctttggctgatctcatcgacgtaaaaaagcacggcgagaagctcaaggcgggattggctgattccggtgcacgcttcaaacttcgtgccgatcactttgtgcagtgattggagctgatacaaaatctcgccttcctctgaacaacatgctgtcaaaacccatccctactttcttttgcgcaattaattgactagtcaatgtttgatatatcaataatatacatccgttattctttttttgcaagtgttttctcctttttaaaaaaagctgccggtgaacggcagctccttcttaatgattatggatttttctgaaattactgccttttacttcagcgacatcatataccgtcacaaaggcttgattatcaatgtcattaataatttccttcagtttggtttcttccaaacggttgatgacacatgtgatttctttgaatttttcatgagaaaaaccgccgtatgcttctttatacgtagcgctccggcccaattcttcacgaatggtctctaccattaatgcaggctcgttggtgataatctgaaatgttttagaaccgcttaagccttcctcaaccacatggatcaccttggatgcgatgtagtaagcaatgacggaaagcaatgcgccttgcagcccgaatacaaaagaaacaaaaataaacacaaaaatgtttaaaaataaaatgagatcgctcgtgccaaacggcaatttccgtgacagaagcacagccagcatatcaattccatctaaggcgccgccgttgcgcaatgccaatcccattcccaagccgagaataatcccgccgacaacggtgattaacagggtatctccctcaatgatagccggcgtgtggtggaaaaaactcgtgcccgcggcaagtgagacaataccgataattgatagaaacgcaaaacctttcccgatttgcttatatcctaaccagacaaacggtatattgatcaccgcaatcaagatcccaagaggcaaatgaaacagctgtgaaccgacaatgctgagcccggttacaccgccgtcagatacactattcggaatcagtacggtttccagtccatacgcggcaataattccgccgatgatgaccatgatgacccgtacgattgatttggctctgaatttcttacgtctttgtttttcgattgtactcatatcattccccgcttcaattattttgtcttatttaaatataccataattgatacttttcgttaaaaataagcctatcggctagttgaagcaggaaccgaggaaggagatttcacagataacgtatccatttatgactttaatcattcacaacgcaatcattcagtaaaaggaattatcatccattaatagtctcttttgtttcccttcttcacatattcccaatcatgctctatattttttctcacccgctgaagaaggctgaaaatggtttctttttcctcagacgtaaagccggacagtgctacttccgcagagtgctctccttctctttgcaataacggataaacctttctccctttttcggtcgggaacagtttttttatttttttattttgatcatcaggacgcttttcaacaaatccttgtatttccagttttttgatcgctctcgccgctgttgttcggtcaactttaatcatttccgccagtttttcctgtatcactcccgggttttcacatatacgcacaagatagagatactgcccttttgttaagtctaattctttaaattcaatattgctgatggaatccaatgcccgtgcgatcatgccgatttcacgcaaaatatcagtcatatcttttcaaacccttcatatttttgttgcacttgcaatataaatgtttcgtcgttacttctataagaccacaagcaagccgtgcagtccagactaatatgtgaaaagggttggttgatcatgaggatacaacagaaattgatttacaagcagcgcttgagattagaaaagcagtattcattgaggaacagcaagtacctgaatccgatgaatttgatcagttcgatacgcttggggaacagtgcgggcatgtcttggtttatcatgagaatcagcctgccggcacaggacggatccgcatcgtaaaccaaacaggcaagctcgaacgaatctgcatcctgaagccttaccgcaaatacgggttgggcaaagtaatcataagcgaatgagaaaacatggtaaaagaaaaaggcatcacccaatgtaaactgaatggacaaacacatccggaaggcttttatcacatcttaaatagtccgattaaaatctattaataattaacagttgaagagatggtgaaaaaagctgattctctctattatggactcctgccgcgttacattttttctatcttcacatatctttactattaagtacgtttaaattgatttcaggaggagatatgaagtggaagaaacgagtatggagccatcacgactctgcaaagaatttgcaagaattctcaattcaacgcccagtgtcgtaaatggcgtatgtacggcgacaagatttcgaagcaacattcacccggtggtactcggaagaagagccgaggcatttccttttattcctcaggccttttcatttgagagcatggactcggaaggcagagccttatgtttaggtgagactgttttactgcaagaagaagtgaacccattaatgagtgaactgcgcaaattcggtatcatcgtaactgccgttcataaccattggctgtttgataaaccgcgtctgatgtttatgcattttgaatcaattgacaaacctctcaattttgcaagaaaagtaagagaggccctaagagttctgactactaaaactgtgcgtgcggtaccaaaaactgacggggaaatgattgaacggcatggtctttgtgacgaattcaacgatattctgggcggaaccatgcatacgtttgaaaatggaatttgtacagtaatgagatcacgaacgaatataaaaccggttgtactgggacggcccggaagatcatttttgctcattccgcaaatgttttcatttgaatcaatgacaaaagacggccgtgctctttgcagcggagaaactgtaattctgcaaaaagaaatcaatccatttatcagcgctcttcggaaacatgatctgattgtaacgtctctacacaatcactggctgtttgacaaaccgagactgatgtatattcatttcgaagcgattgataaacctgtcaacttcgccttaaaagtaagaaatgctttaaaagtgcttactgataaagaggtcgaaggttagcatgtttctaagtatcaaaaagcgattcatataatcgcttttacatatgatcagccgaaaacaaaaaagaggtcagacatttgtgttaaaaacagccttataggctgtcgttttgtgtatattctattgatgagtttatactacttcatcccgcattccatacaagctctttatttctcaatggctttctacatgccgctgtgcaaacaccttcttagctactgaaagagcattaagtacacgcgggaagcctgtataaggaaccaattgggtgatactctctacaatctcagtcggtgttaatccggatgtaagccctgtattgatatgaagttcaagctgcggctcggttccttgcgttacaagggatgaaatggtaacaagcgcacgttgttgattggttaatcccggtcgtgaatatatatctccgtaagcaaattctataatgtacttacttacatctggagcgatatctttcaagtcttcagaaatctttaaatgcgtagaaattttatcatcgtttgttaaagtgtactccattaatttgtctaaaccttgctggtaacggctttgatccatttgaaattcctcctgaaaggtacttatttcctgacataagataatatatcgcagccctctctaaccgtaaaatacataaaaactataaaaaccattcatttttttcatgagtgatcttagtctacgtaattactcttacaaaaagatgaaatataccggataaattcgcgtactgcgtgtgaaacgtattttcctttttttaaaataatcgccactttccaaggaatggatggattgacaatggagattgccttaactaaactttgatcagtctttttcactatcgactgagggaaaatggaaatacctagttcttctccaatcatttcgctgataaaatcccattgagaactttcataaacaatatttggacgaaaaccggctctaatacactcctgaataatccgatcgtgaagagaaaagtcttcactaaacaggatgaaaggttcatttttcaagtcttgcatttccacaatctctttatgaacaagcgggtgagcggaatgaacgaagagcatcagttcttcattaagcaatggaatgatatcaaactgctctttgtccactggttcaataaccacgccaagatccagtactccatcttcaacctcctttttcaccttgtttcctccatgttctatcagcttgatgttcacatcaggatacaattgtttaaaccctctaatgattttaggaaaaaacaagacaccgatcagcggcggtattccaattttcacttttcctttttttaaatgcaaaagatcgtataagttcgtcgacaagtcatctaatgacttcataatcatttggccttgctcaaatacaatttcgcccgcatctgtcaaagcgatttgtctagcggatcgatcaatgagatcaacctttaattcctcttccaaacttttaaccatcttacttaaggcaggctgtgacaaatgcagattttctgatgccttagtaaaactgttggatttagcaacttcaagaaagtatgtgatttggcgtatatccatcgtatgatctccatttcatgagtttaacgaatacattatattctttttattcattttacttatacaactgccgggtgtaaacttttaggagaccaaaatgtttcctggaggggttactatgagtaaattattagaaagtaaagttgctcttgtgacaggcgcggctagcggaattggtttagaaattgcacgtgaattcgctaaagaaggcgcaaaagtggtaatttccgatttgaacgaaaaagccgtgcatcatgcagctgaggaacttaagggacaaggatatgaagtcctgcctgcggtttgtgatgtaacaaacgaagaacaagttgaaaaaagtttctctaagacacttgaaacctttgggcgaatggatattctggtaaacaatgcggggattcagcatgtgtctgatatagaaaacttcccgactgataaatttgaatttatgctgaaattaatgattactgctccttttagtgcgacaaaaagagcgttccctttgatgaaaaaacaaaaatttggccgcatcatcaatatggcttccataaatggtttaattggttttgcagggaaagcagcttattgcagcgctaaacacggtttgatcggtttaactaaagtatcagcattagaaggagcggaatacggaattactgtcaatgccttgtgtccgggatatatcgacactccattggtacaaaaccagttacaagatattgcagagactagaggcatttctatagaaaaggtgtttgaagaagtcatttaccccttggttcctcaaaaacgtttgttagccgtgcaagaaatcgctgattacgcagtattcctcgccagtgacaaagctaatggagttacagggcaggccgtcgtaatggatggcggctatacagcccaataatctaaatttcatctgcaggagtaatagtgctttgggttaaatgatttactcttcaagaaccaagccgatggttttttaggaaagacatagctatacagattgaagtttgatatatatttggtatattaacttaagaaaagccgccctgttggcggcttttttatcctgaatcctgtaatgtgaaaatgttaaaaagcaacggaatagttgttgtcttgcagaatgcgaagaagctgttggagctttcacaaagtatgtgggtgaagctgcagataagtgtgtaagattcccctctccccataatgcgcccgcactttttagaattaatactattctgcttcaatttatcttcaattgttggtattctggcaacgaaatcttcataacgctgaaattggtcaaacggtatacttaattttccggatacatatataatcaacttgaaagaacattagaaatagtcgaagaaaaatctgcagctgtaaaaataccatctaaatggacattgatggagtatgcgtcaacaatataacaattaaattaaattaattcggttcctctttccctaaggagcctaaaaatcagtcacatcatccatcttcagccttcaaacattatcaagccttgatgaggcaagaaacacggggtatcatagacacacaaaaaagatctcattatccaaagtcagattgagtatttttagttgtataagataaaggaggaaatagattgactttacatcattttattggggcggataaagaacttcctattggtgagtatggcagtaatcctacacttaagcccatttctgaactaaaaataaaaggagatgtcaacaaacgctctcaatttaaaaacaatcgaaagaacagtgaaaattcacttgtaaaggtttatgacacagaagaagatgcatacggaattgatattgttcatttagatcctggatatgaagcagtcagaaacaaattcacacatccttatatatatgaattacaagggtacttacatgccaacaatacacctggccaacgtaaatctattaaatcactttttcttttcattgaaaaacacttgtcaaaaggtgaatcaattgaaatatattcctgcttagatggatatgaagatgaagataaagatgaaagcatgggtgtagttatcaatttaaatactttacaatttggaaaacatataaagtttaaagatataaatcaccttagtcatatattctatttggaagataaacaatatgtattagtcaagaaataaacaagaaaaatcccaattgagtaatgttggtttaataagtaaggaaaccattctatacggtttccttacttatatatattattcactaaaatcattcaatttttttataaaaaattgaatgattttaatcccatctttcaaaatgcacttttaatcctggtatactcaatattctttgtatttctttatcatcttcagtatcgatataactttcttcttcatgagagcatgttaccaaccactcctttccatctttaaaaaaagacaagtcttctggtaaatgtggctgctcccaagaatataaagaatttgcggattctttcagaatgttttttgcgttttcatctgtataatagtaataaacttttgctttttgattgtctcctagaatggtactggcccattctgattgctctttcattacttttaacgaactttcaagtttttttaacagaggatcgaatgattttaaagatcccatatcttttcttaaaactaaatgaaattcgtcgcaaatctcgaaagccaaatcaattaactctgaatacagctgatcctttgggttgtgatcaataattaacatagttacctccttctcctattataatttcctatcttttaattactttaaagttaggtgtttataaattaatctaaattatcttgctgccccatagaaagcatgagctttcatacggacaccttttccatgtttatacctagagatcgagtgataatgataatgtttacctttaccctttttatctatctccggaccaacaatttttttaatcggacttgcggctttagcaatagatttggcattgttcttcgacgtagaccaagtgtcatcaccccttttaaggcgtgcaattgcagcaggtcttttcaaaccattaccgataaataatcctttagactttcttactgccatataatgagaataggttcttttacgcttcttaaactcagaataggcaacataagtcactcctgaaatagtcacagctaatccaattgaaattaaatgcgctaaaagtgcctctccaataactattcctataggtataaaccaaacaaaagaagctgttacctcatctgaattaatctcatactttttatttgtttccgtatcagtaaaagttgcttctatcttctcatttgtagcattttcaatatcaactttatattctttacctttttctccagtcttctgagaagtttcatcggttattaatgaaagtttcatattttctttatctaaagtcattaaacctttaactccgcctttttctgctgtgattactaatttctcttcatcatttgttacaatttggtaatacctattgtttatagcctcagcttttgattcattatgtaaaataaaagtaaaagttaatattagacttaaaaaaacagcaatactctttttaaaacatttcattgaaattagcccctttacttaaaagataaaaatccttttccataaatttcatctctccctttctttccaagatcgatggacaatttggacaatacacggttaacttgattataaatatcctcttttgaatcaattccgaatttatctctattttgtaaaattaatgatattactccggtaacatgtgcagctgctaaagatgtaccactttcagttttatatccattattgagggatagtatcggtatatctacaccaggtgcagaaaagtcaatctttcctttaggtgaaaagttagctagtttattatttctatctacagcattaatagagagaactttttcataagctgctggataatcaacatccccgccataattgttacctgcggctgcaacgattatgatcccactgtttactgctttatcaattgcacctcttaacaacggtttatctttggttaatccaaaactcaaatttattacctgaatattattatcaatacaccactctatacctttaacaagggtatctagcgaaccttttccttctgaatttagtactttaactgaatatatctcagtgtctggagcaattccaactaatccaaagctattatctttagctgctataatgcctgcaatagcagttccatgccccacatcatcatctgaggttaaagtcatgtttattggattaaattcccctttaattttcccttttaaatctttatgctctttatcaataccactgtctaatatagcaactttcactttctgtttctctcttaaagtccatattgaagcagcattgatttttttcactccccatggtacttcttgtacacggttatgattaattttttctgtttcatttctctctatatgcttaaaaatgaataaaaagcacgcaaaaaaacctaatgtaaaaattaatataaataataaaatatgaggttttttaattgctaacaccactttttgaagatttgtaaatattctcatccttggccaagaataacaaacctattatatcaatctgcaattaaaaatcaaagtttttcaggaaatatttcattaataaattacggttataaagtagtgtaattcttagttcttagtcatcataaaattgaccttcaaatgcatatttaaaacaaatctcaataaagaccggtatattaacttaaataattttgaagacttctgctagtgacggttttaaagataatctctctcttacagctctttgaatatcaagttctcctaagtattttttaaccagcaccccaaccgtagtcagcgaacaatccgcgtgtcattggtgtcatgtctctttctattaaagtaattatgataaatttatctgcttgccaattccttaatcatcaaacccaattcataaattcccttttgaaggtcttcaagagatgcataagcatatgataagcgaatataactccctttttcctcagcatagatcctgccgagattgagcagaatcccttttgataaggctttggtataaagtaatttcacggatatggaaggcaatatttttacccagacaaagaatcctccctttgggatattccatgtcgccacatctttcaaatgagtttctaaaacactcaaggccaattctcttctcacctttaattgacttctcacctgttctagatgctgctggtattcaccggatataaaccactctgccgctactctctgggataacgaactggagccgtaatctgtttgcatttttatgtcggataaacgttcaatcactggttccggcccgacaatccagccaatcctcaagcccggacttaatgttttcgataaactgcctatgtaaagcacatgcccatttttatctattgttttaataggatccgggggaatctcatctatccataactcacgataaatgtcatcttcaataatgggaagctgtgtattctcacttgccgcaaggatttcttctcgtctcttttttgacattaaaatacctgtcggattatgaaaacaaggatttgtatataagatagccctccccgttctccccttgccatgcggatatgttccggcaaaagtccatcatgatccataggaactccagtcagcttcataccggctgattgaaatacgtgtaatgaataaagataggaaggctgatcaagataaacggtcgatcccctttgtaaaagccccattgatataagctgtaaggcttgcagtgcgcccgaaacaataagaatggaagaaggagaagcttgaatgccgattgttcttaaatagccgcttaatgcctctctcaaaggcaaatatccttttggttcctcatatccgaatgcctctatgttttgggatacctttcccatgatctctttcataacagctaaaggaaaaatctcatgtgaaagttctcctttactgagctgtataagatcagaatttgattctgatttattgatctcttgaacgattttttggcttggctgctgaattccggaggttacatactgatcccaatcgggagcggaattcttagccaaaagtgtccatgtattgttcgtaacaactgtccctttgcccattctgccttcgattaatccatccgccgtcaattcctctaaagctgtaatgactgtgctcctgttcacctcaaagtgtttggcaagcgtgcgctggcttggaatcttacttccgatcggccattctccatttcctattttctcttttataaattgaatgatttgtatgtacttaggaagctttctcatctttttttcttctggagcgctcattaaaagggtcctccttaaagtggttgggtcaaaatctatttaactggttgaagtcatctcatcaaatctttattaatatagaaaaacattaaataactggttggtttttgtaaagaggagtgagaaagatgagaaagaaaacagttcgaatcggcatagcttacagtctgatgattgggttgtgggcatcagctttcccgggaattcgcgcgagtttggagagttacacgccggaacacctcgctttgtttcgcttgttgattgggtcaatggcattggtggtttttgctgttttgactcatatgcgtttgcctgacatgaaggatatccctgctattttatcgttaggatttttaggttttgcactatatcacattttgctgaatatcggagaaaaaaacgtcagcgcaggggtagcaagcttactcgtgaccatgacacctattttttctgcaatgttatcccgtctgttttttggtgaacatttcggtttttataaatgggtcggctctatcattagtttattgggtgtatcgatcatttcatttggggcaggaaactatacaaattcagtgaacggcattttgttaatcttgctggcagctttttcggagagtatttatttcgtttttcaagcccgctatataaaaaaatatggatttatcccattcgttacattcactatttggggcgggacattgccaatgctggtatttcttccggggttatggggagaagttgttcacgcatcgatgaattccacatggtctgtcgtttacttaggcttattaccaacggttgtgccttactttgcacttgcgtatgtcacttcactcgtcggtgcttcagaagcagccatttcactttatttaacaccagccgtagccttggctatttcttgggtgtggttaggtgaagtacctgcgtttattgcactgacaggcgggatggttacagtcgccggggtgtgtttcacctatctaacagtaaataaaaagataaagattttaaatccttatttcttatctaaaaagcaataaagcagatgacatttaaccctgaaaatagagtcataagcagttctcctttttaatacttgggtttcgaaggcttcttctccccaagggtgccagtttacggggttgtgggcgttacctttgttcaagaaaacttgttgcaagcaaattcccccactcccgtaaagaattttgaaaatttacatggcagattgaacatttattgacaaagttaaaatgtaaaaaggtacaaagtgtctattgattaaattattcttttcgtttttattgcgattattgtatgtcttttgtttcttgacaggtttttcattttcacaaataaaaaaacacgctggaaagatgctctaacgtgtcatgatttacttcaaatgagatattgttcaacccattttcttgcaatgttttaatgttgtttactaaatcgggtaattcagcaactgctgattctaatgatgccactccaattacatttattttccttggatttggtgcgtcgagatctaaagggacgtcttcattggcaggtattaatccgggttcataagcaaaagaaagactttgagcaattatcctcttcactccaatttcatgacacgcatcaacagtatttcgcgcacctataattctgattctcgctttttcttcaagattgtaacctgttaaagaggtaaactgatggacaacaacctcaggttaaattttcctaaaagcattaagaacagcatctcgatccattgcatctgcttttacaggagttacccctattcttttgaggaacgtgttcgaccggttacctcgggtcaatgcaaatacttgatggccgttttgtattaatttaggaagaagggaccgaccaattactgcagtccccccagcaacaatgatcttcatgctataccttatttacctgccaatcttgaagcagcttcttcaacttctttatttgctttttgtaaaacatcctccggactcagtaaagctgttccttgcactcggataatttgataatcctcaataccgaggaaattgaacattgatttcagatatttatttgagtattcaacttcttcataccagtcatcatttgtataaattgatccgctagcttgtatgacaagcattcttcgtccatctttaagcagacctactgacccagtgtcagtatatctaaatgtttcacgtgcgatcataatattgtccatatagtcttttaattttgatggaatattgaaattatgcaaaggcaaaacaatgacatacgtttttgcacttttgaattgtttcaatacttctgtcatgcgtcctgttactttttgttcatcgcttgtcagttcttcgcatttttctgccttatcccatgcacttaaaactgttttatcaatcataggcacatcatcactatataagttaatttgctcaagctcttcactctctggaattaattctttgtaagcctctaaaaagtggttcattacccgtagactgtatgatgacgtatcatctacttttggatgtgcgttaatgataagtgttttgctcatttgaaactctcctttcattttatattaaagactatattaatcgacgattaacttggtcactaatataaaccttgtattttattttgtcaaacggaacaaatagtatctgaagaagggttttaagattgactatcatcaaaaatactcctaagatacaatgtgataaaccttaaaatcaaaagcaggtgagtttatatgcagtacagtgttggggttgaatatgctttacattgtctggtttatttaatagatgttccctccaaggaaagtgtcgggattcgggaccttgcagagttccaaggactttcagaaacatttctttcaaaagttttcggtaaattatctaaagctggtattgtaaattctgtccctggtgtaaagggaggatataggttagcaaaatccccggaggatatttccttttgggatgtaatagaggctgttgaaggaccaaaacccattttccaatgtaaaaatattgtaagcaatggtctactttatcgagacaaatgcaactcttgtgaatccagcaattcttcttgtacaattaacttggtaatgcttgaagcagaagaacagatgcgtaattatcttcgtaataaaacgctcgcatggttaaataaagaattggacgtagtattgcctaaaaaaacaaggacagatactcgggaatacttcataaaaaaaagctctgactaaattaattagtcagagcttttttgtgcttcaagatgccttcggagaatttttacgaaagtatggacgagacaacaaaatgaataaaactacagattaagtttaaccctccgattcggagagtcaaaggttaatgttcgcctttttgttctactttatgaaagggtcagcaattgctgatattataataattaatcaactctttgtggaatggatgataacaaatgacattaggccaaagattaaaatgggctcgaaaaaaatccggttactctaatcaagacgtgccagcagagaaaattggattaacagggtagacattgtctaattacgaaagggattatagatcgcccgatccggagacattaaagaaactcgctgatttatatgatgtatccactgattttttggtcggtagagaagaaaaggacagacccaaatctaaattggatcaaacagtcaatgaagcaattgaacaacttaaaaacgaagagactttacttttcatgaaagatgatgacattcaaatattatatgactataaataaaaaagtgaggttttatagacttcactatcaaacagttcactactcaattattttttcattgtttgttgttgcgcttgcgttttcaacactatgtgcttcaccatgaccaggtccaaaaagatttaatattacaactcctacaagtatcaaaacaatcccagtaacactggcaatgttaattttttctttccaaatcaaaatcgaaattattgtagtagcaatagtccctacaccagaccaaactgcataggcggtattcaaaggtatggacttcattgcaagtgataagaagaaaaaggaacctataaaagcaataattgcaccaatagtagggtaaagtttcgtgaagccttctgcggccttgagcatagaggaaccaataagttcaccaaaaattgcgagcaataaatataaatatgccattgttaattctctcctcctgtataaataatcaacgtcttataaatttgtactaaacctctatcgtttgtttcattatttctttattagttaccactttacaagaaacagcaaatgtttataagtctttattttgcaaaaaaattgtgcgcaaaatgactggtgttccttagacgagtagataaaatctaatctagttaatctaataaggtataaactaaactccattatggtaaagtaaaaatagcaaccaatttaaaagtgaaagaaggtgatccaatgccaaataacagtacacccaatagattaatcgctgagaaatctccatatttacttcaacacgcccacaaccccgtaaactggcacccttggggagaagaagccttcgaaaaagcaaaacgcgaaaacaagccggttcttgtcagcatcggctattcgacttgtcattggtgccatgtaatggctcacgagtcctttgaggacgaagagatcgccggtatgttaaacgataaattcatagccatcaaggttgatcgtgaagagcggcctgatgtggattccgtgtatatgagaatctgccagctgatgacggggcagggcgggtggccgctgaacgtgttcgtcacaccagatcagaagccgttttatgcggggacgtattttccgaagacgagcaaatttaaccgtccgggctttattgatgtgcttgaacatctgtccgaaacgtttgcgaatgaccggcagcatgtcgaggatatcgccgaaaacgccgccgctcatcttgaagtcaagattcacccggctgagggcatgcttggcgaacaggcggttcatgacacgtatcgccagctggccggcgggtttgacacggtgtacggcgggttcggccaggctccgaaatttccgatgccgcatatgctcatgtttctgcttcgctactacagctatacgggcaaggaacaggctttggccggcgtaaccaagacactcgacggcatggcgaacggcggaatttttgatcacatcgggttcggattcgcccgctactcgactgataatgaatggctcgtgccgcattttgagaaaatgctgtatgacaacgcccttctcctgaccgcctatacggaagcctatcaagtcacgggtaatgagcgctacaaacagattgcgatgcagatcgtaacgtttattcagcgggaaatgatgcatgaagacggcagctttttctcagctttagatgctgataccgaaggccgtgaggggaaatattacatatggtccaaaaaagaaatcatgaatcttctcggtgatgaactcggcccgctttattgcaaggtgtataacatcacagatcaaggcaattttgaaggcgaaaacatcccgcacctcattttcacgcggcgtgaggccatcctcgaagagaccggcctcaccggacatgagctggccgaacgccttgaagaggcaagaacaaaattgctggaagcgcgtgaaaacagaagctatccgcatacagatgacaaagtgctgacctcatggaacgcgctcatgattgccgggctggcaaaagccgcaaaggtatttcacgagcctgactttctcagcatggcggaaacagcgatccgctttctcgaacgtcacctcatgccggacgggcgcgtcatggtccgataccgcgagggcgaagtgaaaaacaaagggtttatcgatgattacgcttttctcatctgggcttaccttgaattgtatgaagcgggttttcatccgtcttatctgcagaaagcgaaaacgttatgtacaagcatgctggagctgttctgggatgaacggcacggaggttttttctttacggggaatgatgccgagactcttcttgtcagggaaaaagaggtttatgacggagccgtgccttccggaaacagcgcggctgccgtacagttgcttcgtctcggccgcctgacgggtgatgtatcactgattgaaaaagccgaagcgatgttttccgtgttcaaacgggaaatagaggcctatccgagcagcagcgctttcttcatgcaaagcgtactggcacacacaatgccccaaaaagaaatcgttgtgttcggaaggaaagatgacccggacagaaaacgtttcattgaggcgcttcaggagcatttcactcccgcctatacgattctcgccgcagaacatccggatgagcttgccggcatttctgactttgccgcgggttatcaaatgatcgatgggaagacaacggtctacatttgtgagaatttcgcctgccggaggccgacgacggatattgatgaagcgatgaacaccttacaaatcagcagcagagcctaggcggcctgctgcttttcttttttcacaaaacggaatgcgagccatgcgaagatgatgttgatcaccagagtcgatatgcaatcgtatatttcatagccgccggctgctgttgtaaatatcgacggaatgccgccgtataccgaatgatcctctgtgagaaagataaataaaaacatattattggcagcgtgaccgccaagggacatctccagactgcccgttttaatcgtgataaaggtccagatcatgccgatggtaacatatccgattcccgcccagagagctccattttccatctccggatttccgaaatgaagtgcgccgaataatccgccgataatgaccgtcagaaccaccgcgtttgccgtcaattttccggcaaactgaagcagaaaaccgcgaaagagaaattcctccgcagaggtttgaatcggcaccaacaagacggccgccgctaacagcagcagaaaacgtgaagcatggaattcctgaagcgtgaaacgatccggatgaattaaaaaatcaatcagccccgcgacaaacatcagcacaacatatgtgccgaatccaaagaaaattctcttccagttcagcgactgattcggtgtaatgatggataaaaaccgccgcttcataatgaaacgaaccgctatccaaatgcccggaatcgctatgaaatagacgatatgctgtaaataaatatccgccagcgggtcacttaatgccgcctcatcccaatttatcgtcagtgaaggattgaaagcggacgtgagaaacatataaaacacggtcagtatgcttccgaaaaagaacaaacccacaatgagcaacagagaaagaagatatctcgatacactatttcttccctctgcgggccgtacaaatgtattcatatttatgcatcaacttcctttccttcaacattttacaatataaacagaaacagatataggaaatgttatatattttaagaagaaagcgctatgccgtttcctttggctctggttatttacactctgtttttgccaaaaaaagacctttataatgtattcgtcagataaatttacagtattttctgattacaattgctaagtcagggggttttttatgaaacatcagacattctcaaatgtagcgaaccgattagaccgtctccccatttcgcgtgtgcactatcaagtattaaccgctctcggaatcatctattttttcgatctcgctgatctgtttacgctcagcaacgtggctccggcgctgattgagcattggggcgtgaagctgtccgtcattgccgacgtcacagccgcatccttcctgggcatgtttttaggcgcctccatcggcggaagactgtccgatcggatcggcaggaaaaaagcgctgaattgttttgtccttgtcttttcgatctcatcttttctgaatgcgctggcatgggacattccgtccttaatgattttccgcttcttgaccgggctcggcgtcgcggccgccatgattgtgacgaacagctatttggcggaattttttccatcatccgtacgaggaaaatacatctccttttgcgccatgatcggactgatcggcgttcccgtcacaaacgttgtttccgcttttgtcattcctttaggctcatgggggtggcggctcgtattcgtatggggggcggccggtctcatttatttcttttttatccgccggcttgaggaatcgccgcgctggcacgaaaatcggggcgcatatgatcaggcaaacgccattatgaaccgtcttgaagcacgtatagagaaagaaaaaggcccgcttcccgcgccaaaagaggcggcagaagtacatacagtgaagcacgcaggctacttagggctgtttcagggcaggaatttaaagatcaccatcatcctgtcagcggtatggattcttgaaacctttggcttttacggctttgcttcatgggtgcccagcctgctgaaaagcaacggcatcaccatggaaaaaacgctgtggtacaatgtgcttcactctgtcggcgcaccgcttggcgcattgctcggttccatgatatccgagacgttccaaagaaaatggattctggccgcaagcgcttttctgactgccattgccggactgttatacggcatgacgtttattcccgtcatgattattgtgtttggatttgtcgtcaatgtcacggaacgggttttcacctcaaacttatacgcatatacatcggagccgtatcctacggaatatcgctcggccgggagcgggctggcatacgggctcggccgtttttccaatatattcggatccctgctcgtcggatttattgccgttaagctcggctacatcagcgtctttttgttcatcggcggctgctggcttctatgttccgttttgttaattctattcggtccgaaaactaatgctcagcaaatttaatcaataaaacagtgcgggttccccgcactgttacactgtgatttctatcaaattgccttccccatcctctatcacgctctcataatatccgtcacccgtcacgcgcgggccgcttacaacctgaaatccgtcatttttaaacgtctccgtcaattcattcacccgctccttgctgcctgtagaaaatgcgagatgcgcccatccggtcatattctgtgacggagcttcatcaatgccgccttttttcataagttccagcctgcatccggagtcaaacgaaagaaaatacgatttgaaatcttttttctcattatgataaaggtcattggccttggcgccgaagtatttctcataaaattctttcatccgttctaaatctttcacccatatggccgcatgttcaattcgcatatgtccgcctcctttttttttctcaatctagttataaagcatgaaacccatttcagctcaagactttttccgctgaaattgatgcataatttgttttttagccgtttctccgtgcaaaaacagcaaaaatgcttcccttccgacccgttccaaatgaagttccagagatgggatattcaatgcccggctgacgctcaggtttccctcgccgatgatctccgcgtcccatttctgttctttcgcaaactggtacaagccggcagccacatcatcactgtgcgcatagatggccgtcggcgccttgtggaaaccccagaagtgttcacctgcccgctttccgtcgtccatatcatggcatccgatcagaatgcgggtttcatcaagagagccgaaaaccgccttatatgcggttaccttgtcggccgtactcgggcttttttccgcttcccgcacacatgtaaaagcaacatcttgatgcccgcggtttttcaaatacaaaaagctttctctgtaagctgcctgcctgtcattataagcgcagggaatctcttgatgctgcgtatattcacaagcgacaatgggaccgtactccagataaggcacagcggtttcccattcattcgcgcgggacgtgacaatcagtccgtcaatctttttcattttcagcagttcgaaataggtcatctctatagcggggtcatagttggtggggagaagggttgtcacgtaatcatgggcaaacgcttccttcgtgataccgtttacaattttgtcaaagcagggatggtcgctgtacggcaaaatcacgccgattgtattggtctttcctcgaatcagatcaatggcggttcgattaggggtataatccatctccttcatcacttgattcacaagacgccttttctcctcagatacgtacgggtgtcggtttaatacgcgtgatacggtagccaccgacacattcgccagtttcgcaatctcttttatatttgccatgtgctcctccatttttggtgataaaaaagcagcaagagtggatttctcttactgctatctcatcataaatccactgtcatttcaacagggcaatggtcagaacccatgatatcggcgcaaatggccgcttcgctgatccgcggcttcagtctgtctgaaacaatgacgtaatcaagccgccagccgatgtttttctcacgtgcgttcgtcctgtaagaccaccaggaataggcgccttcccgatcaggatataaatagcggaatgagtcggtaaatccggtgttcagcagggcgctgaacgcttcccgctcctgatccgagaaaccggcgttcttccggttggctttcggattttttaaatctatctccctgtgtgcgacattcagatcgccgcataatatcacgggcttcttccggtcaagcttctgcagatactccttaaaatcggcttcccattgaagacggtaatcaattcgctctaatccgcgtttggcattcggcgtataacagttgacgacgaacaggttctcaaattcaagtgtgatcacccgtccttcttgatcatgatcgtcaattcccagtccataaaacacgtgaagcggcttttctttcgaaaaaacagccgtgcctgagtagccttttttcaccgcgtagttccaatagtcatgatacccttcaagctgtaatgatacttgtccgtcctgtactttcgtttcttgcagacataaaatatcggctttcgtttcctgaacgtaagtattgatatctatctttttcatcacggcacgtaagccgtttacattccaagaaatcagtttcatgtgttccccctgtccggctcagccggcattccagtgtttcaatgtttccgccctctaatgccagcatctgctttttcatttctaaaccgcctctgaatccggtcagttttccgttttttccgatgacgcgatggcacggaaccgtaatcaataccggatttttcccgattgcggcgcccacggctcttacggctgccggtttctgaatcatttctgctatatccgaataggagtatgtctcgccgtacggtatgtccataagcgctttccatacagcaagctgaaattctgtcccgtaaagatccaccggcactgaaaaagctgatctgccattttcgatgtactcggacagctctgccgtgtaagacgccagcttctcatcatcacgtgccaatcggtattgcggcagtgatttttttgcccactgctcaagctcttcaaagcttccatgatttgaacctataaagcaaagccctttagatgtggcggctgtatacaggctccaatcattccgtgtgaaaagtgtccaatagaccattgtctctttactcatattgaacctccctgtcccattccggcagtttttcggtattctgtgggcgaattcccggttctctttttaaaaagagtggcaaaatgcgctgtgtttggaattccgaccgtcagagcaatctccatgactgtcatatcagtatgctttaaaaggtgttccgccttcgccaatcttatgttctgtatatactcaatcggggatattcccctgatttttttaaatgtccgctgtaaatgataagggctgccgtgacacatttcggccagtacactcagagtcagagattcgtgataatggcggtcaatgtactcaatgatttgagcaatccattcttcatcaggaagacgaagaccgttcggccggcaccttttacagggacgaaaatgtttatcaagcgctgcatcagccgtatcaaacaccagcacgttttctttattcggagctctcgatttacaagaaggccggcagaaaatccccgtcgtctttactgcataataaaatgccccgtcataagaagcatcattgcgtatgattgcgctccacttttcatcagtcaggatatttctgtctgtctccatctcagccaccccctgttcttcagtataaacaaattcattgcataagtacgcgtatttgaatagaggagcaagataacaaagatagatgtcaggagcacttccatgtttcatgtgaaacatttcggcaggatggaggaggactgatataaaaaaagagcaggagcccgcaggctcttgctcttttctttcggcttactcgccagttacgtatggaagtaaagccatttgacgtgcgcgtttgatcgcgatagtcaatttacgttggtatttcgcgtttgttccagttacacggcgaggtaagattttaccacgctcagaaacaaactttctaagaagatctacatctttgtaatcgatgtgcgtaatgccgttagaagtgaagtaacaaaccttacggcgtttcgcacgaccgcctctgcgtcctcctgccattgtcatttcccacctttctcgttatgaatatagcgataatctattagaacggaagatcatcatccgagatgtcaatcggcttgccgtcgttggcaaatggatcatcattaaagctgttcccttgatttcgtctctggttgttctgatttccgccgaacggattatcattttggcctccgccaaagtattggcctccgccgctgtttccttcgttgtatccgcctgatccagaaccgccgctgtttttaggctcaagaaattgaacactttcagcttggacttctgtcacgaagacacgctgtccctgctgattttcataatttcttgtctggagtcggccgtctacgccggcaaggcttccttttttaagaaagtttgcaacgttttcggcttgtcttctccaagtgacacaattaatgaaatcggcttcacgttctccggactggttcgtgaatgtacgattcacagcaagagtaaacgtggcgacagccgcaccgcttggcgtataacgaagctctgggtcttttgtcagtcttccgactaatacaactcggttaagcatatgaaagaccaccttttaacattatatatttcaaattgcttattcttcttctttaacaacgatgtggcgaatgatatcgtcactgatcttagctaaacggtcgaattcagcaaccgctgcagcttcagactgaacgtttaagatttggtagaaaccgtcacggaaatcgttgatttcgtaagcaagacgacgtttaccccaatcttttgttccagtgatctccgctccgttagaagtcaatacgttgttgaaacgctcgataactgccttctttgactcttcgtcaatgttcggacggataatgtacataacttcgtactttttcatctgtttgcacctccttttggtctaagcggccctataatgggcaaggagcaataattctattactcacaagtttatattataccaaagctcttgtccctttacaactgtgtcctatacattaaatcggaaatgaatgacatctccgtcttggactacatattccttaccttccagacgcacttttccggcttctttcgctccggacattccgccgcctgccaaaaggtcttcataagcaaccgtttcagcgcggataaagccgcgttcaaagtcagtgtggatgatacccgcacactcaggagctttcatgccttttctgaatgtccatgcgcgcacttcctgttcgcccgccgtaaagtatgtcgcaaggccgagaagagagtatgacgctttaatcagctgatcaagacctgattcttcgatgccgagctcctcaaggaacatttgcttttcttcgccttccaattcagcaatttcagactcaattttcgcacagacgacgataacttcggcattttcacccgcggcgtactcacggattttcgcaacgtattcattgtctgaaggatcagccacttcatcttcgcttacattcgccacataaagcacgggttttgacgtaagcaaatgaagctgcttcacaagcttttgctgttcttccgtaaattcaacggaacgggcaggcttttcttgttcgaaagcttctttcaatttagacagaatgtcaaattcaaaaaccgcttctttgtctttttgcttcgcaagcttgcttacacgcgtgatgcgtttttcgactgtctccatgtcggcaagaatcaattcaagattgatcgtttcaatatcgtcaatcggatcgactttccctgacacgtgcgtaatattgtcatcagcgaatgcacgtacaacgtggcagatcgcatcaacctgacggatatgagaaagaaacttatttccgagtccttcacctttagatgcgccttttacgatccccgcgatatcagtgaattcaaacgcagtcggcactgtttttttcgggttcaccaattcagtcagcttttgcagacgttcatccggcacttccacgattcccacgttcggatcaattgtacagaacgggtagttggctgattcggcaccagcctgggtaattgcattaaataacgtcgattttccgacattcggcaaaccgacaattccagcagttaaagccattctttcatctcctctatatcaaaccatcatcgtataaacgtattgtaaacctagagcaattataaggaggttcataggaaaagacaagctgagaaaaaagcatttcccgccctctctctccttagattacccttttttaaccgctaccagacagtcaaaaagcgtacttcccattccattatcggaatttgaatcctttgtgagcatgttgacggagcctccgaatgccgcccacatgccttcatctatattcaccgtcttcgggtgagcctgcttcatgattttcaccctgccgcgcagacggccgcggtcattgtatacctctgccgtatctccgtcttgaagtgaaagctcctcggcgatatccggcgacaggtccacctgaatctgctggagcttttcaataaacggcacgtgctgtgaatgattggagcgctgcgggtgaatggacagcagcgtatacggatatttcccggccagtccggcgtcgtgataaacggactcctccggcacttccaattgagggaggccgctgtatcctttctcttctgccagtgacgagacgaattcaaattttccgctcggggttaaaaattgaaaatcactccacggaacctgtttaaccggaagcggcatatgtcctttttcctttaattgctcaagggtgattccttctttctccaaagaagagagccccatttttaagaaatcttccgcactgtaatcaaacagctccccgaatccgagacgctttgcgagttccgtccagatccagcggtctgattttgcctctccctgcggttccgcaagcttcttaccatattgaacatagtgatgatacatgctggaataataaatatcttcctcttcgaaaacaacggccgtcggcagcacatagtcacagagcttcgccgtatcggtcatgaccgaatcaatggccactgtgaccggcgttttttcaaacgcttccttcactttttttgtattcggcacctgtgtcagcggattgccgcacgtcacgatgatcatctcaatcggcgggtcggctgcattcagcgcctcttcagcttgagtcatcatcgaaaacgttctcgaacttttcttcaaatcaggacgagtgagctcggcctttgcaaagctttcaccgacttgcacatttccgaagttggcgccgccgcctttgataccgacatttccgctcgccgcagctaaagcgtcaatccaccgtatcgtcccgcccccgtttttatatctctgcatcccaagacccataaaagtggaggcgggaccgtcagcatataaatcggcaagatattcaagcgcttctaaagacgtttctgttttctcaatgatctcctcaaaagaaatcgtctgcagaagcttgtctatttcctcaaaaccgaccgaatgcttttgaataaaatcagaatcggttctgccggtttggcataatatttttaaaacacccgccgcaagccagccatccatgccgggtttgacggatatataccggtcggcaagctttgcagtcgggttaaaaatagggtcaatgaccgtcagtgtcgctccttttttcttcacctgctgcagatgatgatagaggtgcatattcgtccgggacacgtttctgccccatacgatcacatgcttgctgtgataaatatcaagcggtccatgcccgtaagaacgcccgaaatcccagcgctgcgcttcaatgccggaaccccagcaaatgctgcccgcaatctcggttacaccgccgtatccattgaaaaaacgctggtcgagcgccttcaaaagaccgttattggcgtagtcatgactgtgcagcactgcggcagtgcccaacgtctccttaatcaccgtcattttttcagcaatttcatctaacgcctgctcccaggaaatgcggacaaattcgccgtctttcttttttaaaggaaaacgaagccgttccggcgcattcgttttcgtctccagcattctgccccggccgcaaattttcccttccgtaatgggatgattcgggtctccgtctactttcgtcacctttccatcctcaactgtcaccaaaaagccgcagctgtcccagcaattcagcgggcacgctgactgatgcactttgctcatcgggcctcttcctctcctctatatgaaaaagcatgagcgccagcccttatgatgtaggctcctcatgcttgacgagtacttttttcagctttctctcaaaatctcttctcggaatcatgacactgtgggaacaacccgtgcatttgatccgaatatccattcccatccgaatgattttccacctgttttcaccgcaaggatgcggtttcttcatttcaacaatatcattcaggccaaagtctttatccgccaagacccttcacctctctccatagactgctttatttattgtacaaaaaaagacaggataagagcaacggccgcactcaaaatgagcattatacttttttccatctccctaaaatagggtaaagaagaagacataccagcaaataaagacttaaaagcccgtaaatgggatataaaatggcgatcaaatctgaaaaaccgattgtcgtaaaaggcaccatcacagctaaaagaagagatacgagcgtccatctcggcaatttcacaaatgcaagcatgcggctggacagcccgaaaagaccggtcaccgttgtcgtatagatggctaaaaaaagcacggcggccatacaaagaaataacggataaggagcgccttcaaggacggcgaaaagaggaatctcatattgtgtaagactgcctgaaagctgtacaagcgtttcattgtaaacaaatgaaatcataccgaaaatcagcccgcttgcaacgcttgcgattttggcttctcccagtcccttcatatctttcccgattgaagaaagaacagcgacaacagaaagaatgtttaaggacgtgaaggtaatgcttgccggccaattatactggcgggtcaagtctatcgtccacgtgtaatgatgcgttgtctgaaaaaagaccaatgcatataacagccccgctacaagaatcggtatcaaaatactattcagagataatatcccttttatatcccaaaagaataaacccacggtcacaatgcaaagaagaaaaataccgatccaaaacggcagcttgtacatttgcagcgtcacaccgccgccggcaatcataaccatcgtcattgaaaacaaataaaacataataagcacatcatagactttagcaagagccggtcccatcagatgctcaagcacaggtaaaaagtgcgttgattgaacccgatagctgatcttcaacacaatataagccgaaatcgtaaacatgactgtaaacaatacaatagccagtccgctttcgacaccgaaaaactgccatatttcctgcccgcttgcatacccggccccaatctggctgcttaatatgagcagcatccacttcatcccggctctccacaccctcatcacctcataaaatttctgatcatctccgcatattgctactatattgagtgacagcagcaaacattcatacaaatgggacaaatatggtatgataacgacgattgactattcagaaaatttatttatgttaggcgctcaaatcatggacatcaggcgtttaaccgcaagtgatacccagccttactccgattcaggctcaaagctttaaaagatcacccggacgcaatcgccgtcagctatgaggccgtccgaaaaatgcaaagccaggcttgaagccggcaatgccatcttgcttggcgcctttgaacaagacagcctgataggaatcctcaagatctccaagcatctgctgtttaaactaagacacattgcggttatcggttctatgtatatttcccccaaacacctagggtcaggcgcgggaaaagctttaatgacggaagccatcagccgggcaaaaaagatgaaagacacagaacagctccatctctctgttacttcaacaaatggaacccgcaaaaaaactctgcgctcagttaggattatcctcttctctgcagaaaaaagagcgctggaattagatcatcagcaatatgttgatgtagatcatatggtcttatttctttcatgaacttagagaataactgctctgagttcttttttctatccgctcttttcaaacaaccggcatgctcatcatgacataagcataaaaaaaggcagcgctggatatactgtaaacaaccatacatcaccaaaaacaacaatgtaatactcgtatgacatgacaaggaagtgaaccttatgaatcgaaaaggcgggcttttttctcaagaacgggcaaaacaatatgtatcccatacggattcttctgctgcgaatcaaatacaagcaatccttacttcatctttacgtaaagcagccggcagaccgttagtcaccgtgtgtatcggtacagatcggtcgaccggagattcattaggtccgctcgtaggaacaaagttagaaaaaatgaatttaggcagattgcacgtttacggcacgctgtcagatcctgttcacgccgtcaatatgaaagacaagctgaaagatattcaacatctacataaaaatccgtttattatagcggttgatgcttgtttaggccgcgtcaaaagcgtaggctcatttcaaatcggcgatgggccgctgaagcccggagcaggtgttcaaaaagaccttcctgaaatcggtgacgtccatatcaatggaatcgtcaatgtcagcgggtttatggagtattttgtcctgcagaatacgaggcttcatcttgttatgagcatggcaaatgttttagcagaggggttacagctgacagataaatcagaaggccggcaggaacggctcagtccgtttcataagctgacaagacgtatataaaaaaccatcttttttaaaaaagatggtttttacgcttctctttcggacaatagttccaggatacgttcaagatcttcatttgagaaaaactcaatctcaatcttcccttttttcttttgtctcttaatattgactgttgttccgaagtaattttgcaaatacgattcccgctcttttaacacaacatcttgaacaggttcttttttctttgtttcacgtggaacattgttgtttaactgctgaatcagctgctcaagctggcggacgttcagctgttcttcaaccactttcttcacaagcggttcaagcttgtttttatttttcaagccaagcaaggttctgccgtgtcccatggataacgtaccttctgcaatgaggttctggatgctttccggcagcgtcagcagtcttaaatggttggcaatatgaggcctgcttttcccgagccgtttagcgagctgttcctgggttaaatccaaatgcttcagcagtgagtcatatgccagagcttcttcaagcggtgataagtcttcacgctgaaggttttccaaaagagcgatttcccgcatcagcgattcagataaatcccgcacgatagccggcactgtctctttaccggcaagttttgcggcgcggtaacggcgttcgccggctacaatatcatagcccttcaatgattttctcacgataatgggctgaagaatgccatgctgaatgatggattccttcagttcagctaatgactcatcatcaaattgttttcttggctgataaggattggggcgtaaatcactgattttaatttcttccactgtctcttcagacaaatcaacctgattaaacaacgcgttaatcccttttccgagcccgcctttagccattcgctgccacttcctttgctaaatctaaatatacttccgcacctctcgaacgcggatcgtataatatgatcggcttgccgtgactcggcgcctcacttaaacggacattgcgaggaataatggtttgatacactttatctctaaagtatttctttacctcttctatcacttgaatgccgagattcgttctggcatcaagcatcgtcagaagcactccttctatcattaagtcggtatttaaatgtttttgcacaagccgaactgtatttaataattgactcaatccttcaagagcgtagtattcgcactgaaccgggataacgactgaatctgaagcggtaagcgcattaatcgttaataacccgagagacggaggacaatcaataatcatgtaatcgtaattttgtttcacagattctaatgctcttttcagcctgacctcccgtgagatcgtcggaaccaattcgatttccgctcccgcaagctggatcgtggccggaatgacatctaagttctctactgaagtcggtttaataatatctgtaacatctgcatcatctactaaaatgtcgtacacacaatgatccacatcggctttttcaatccctaatccgctcgttgcattgccctgcggatcaatatcaacaagaagaacccttttacctatgtaagccaagcaagcccccagattgacagaagtcgtcgtcttcccgactccgcctttttggttcgtaattgctatgatttttcccacgatgtcacctaccttcacatgaacatgtactgtcttgtttctatcttatcaaaaaaagagtaaagcgttttatttttttcataatttgtttatcagcaagtgaaaaaaatgtaaacgaaaaagacactttctaatataagttctccgataaagtgacttttttgactgtaaaaagacaattcacgacacaaaaagataaaattttacatatataatgtatagtgcacaataaatctatcattatctcaaaatagttttttgattaaaataaaaactcccctgctgatcaggagagtttttatttaggtatccgaatggtaagctggatgtactcttcgaattcttcttcttcagtgttcagcctgacgccgctgtcttccaccatggacagtgactgacgaatcgtattcatcgcaattcttgtatccctgctgaacgctttgcgtctcggctttggtttctgcttattctgttcaagcattttcaccactctgtcttctgtctgcttgacgtttaagcttttctcaatgatttccgcaagcaatgtgacctgaaactccggctgtttgagcggaatcagtgctcttgcatgacgttccgtaatttttttctccataatcgcatcctggacgggttccgggagctttaacaatcggagcttgttcgcaatcgttgactggccttttcctaagcgctgcgccaaggcttcctgtgttaaatcatgaagttctaacagccttgcgtacgcatgagcttcctcaatggaggacaattcttccctttgcaggttttcaatcaaagcgacagatgctgtttccgtatcagaaaaatctttaataattgcgggaatcttctcccattcaagcgtctgtaccgctctccagcgcctttcacccgcaatgagctcatattgtccttcatcttctgtatgtctgacaacaatcggctgaatgatgccgtgtgtatggatagtcattgctaactctttgattttttcatctgagaaaatggtgcgtggctgaaaacggttgggaacgatagcatgtaccggtatttcgagtatctcttctttgtttgtatcatgctcagctatctccggttcctcttccttctcaccaaacccgaagaaacgagagaatgaatgcttcatgtacctacaccacctttaaaaactgccatttttataattctattttctcatggtttttcctgctgtatcttcatcaattttgcagaaaatatgatggaattgtcacatcaggctgtctaaattacccttcaattggcgatttatttggagtacccggttttctcggatattttttcggagtgcttttcgtcttgcgaatgatcataatgttccgttcactttcttcaacgggaagtgtaaaggaatgaacttgttcaagctctcctcccaatactttaatcgccttttgccccgctttcagctcttcatcagcggctgcagcttttaatgccgcaaaaataccgtttttcttggccagcggcagacaaagctcactcaggaccgacagacgcgccaccgcacgggccgtcacgagatcgaagctttcccggacgtctttccgctgtccgaatgtctccgctctgtcatggacaaatgtcgtatgctctaattgtaaagcatcagagagagtttccaaaaacgtaatccgcttattcagtgaatcgacgatggtgacatgcagatgcgggaagcagattttgacgggcaggcttggaaaaccggcgccggcgccgacgtcacaaagagtggtgaccttttcaaaatcaatataaaatgccgccgttatcgaatcataaaaatgcttgagataaacttcctttttctcagtgatggatgtcagattcattttttcgttccattccacgagcatccggtaatacaactcgaattgctccagctggcggtcagaaagggaaatccctttctccgctaaactggatgtaaattgctctatattcatgccgtcatcctttctattcagctaccttggcaatacggccctgctccaggtataccagcaggattgaaatgtctgccggattgacgccggaaatacgggacgcttgagcaactgataaaggacgcacttctttcagcttttgacgcgcttcagtagcaattcctttaatggcgtcataatcaatccgatcagggatttttttgttttccattttcttcagcttttccacttgctgcaaggatttttcgatatatccttcatatttcacctgaatttccacttgttccgccacatcttgcggaaccggagaatctgcaggcgcaagttttgtcactgtttcatagttcatttccggacgtttcattaaatctgtgccgcgcactccgtctttcagctcgcttccgccgagtgaacggatatattcctgattctcaggagacggcttgataataacagaccagagacgttttttctctgcctcgatcgccgcttttttcttctcaaacgcttcatagcgctcatcagaaattaagccgatctcatggccgatttccgtcaggcgaagatccgcgttgtcgtgacggagcagcagtctgtattccgcccgtgaagtcagcagacgatacggttcattggttcctttcgttaccaaatcatcaatcaatacaccgatataagcatcggaacggctgaggatcacttcttcttttccaagcgctttgcggcctgcgttgatccctgccataattccttgcccggctgcttcctcataacctgatgtaccgttaatttgaccggctgtgtacaggttagggatttttttcgtctccagtgtaggccagagctgcgtcggtacaatcgcgtcatactcaatcgcgtatccggctctcatcatctgcaccttttccagtcccggaatggtcgccagcatccgctgctgcacgtcctcaggaagactcgtggatagaccctgaacgtatacttcctgcgtatttctgccttccggctcaaggaaaatctgatggcgcggtttatcattaaaccgaacgactttatcttcaatcgaagggcagtatctcggtcccgttcctttaatcataccggaatacatcggcgaacgatgcaggttgctgtcgatgatctcatgagtctcaggactcgtgtaagtcagccagcaaggcagctgatcggtaatgtattcaaccgtttcatatgagaaagcgcgcggaaccgggtcccccggctggatttctgttttgctgtaatcaatggaatcgcttgagacacgaggaggcgtgcccgttttaaaacggacgagatcaaaaccgagctcctctaagtgctcagaaagtttaatagacggctgctggttattcggaccgcttgagtaagacagatccccgagaatgatccgccctcttaaatacgttccggttgtcagcacgaccgtttttgccttgtattcagcaccggtttgcgtaatgacaccgcggcactctccgtcttcaatgattaaacgctcggcaatcccttgaagaagtgtcaaattcggtgttttttccagcgtatgcttcatttcgtgctgatattggaatttatccgcctgcgcacgcagcgcccgtacggccggaccttttcctgtattcagcattctcatttgaatatgagttttatctatatttctagccatttctccgccgagcgcgtcaatttcgcggacgacaatccctttcgcggggccgccgacagacggattacatggcataaacgcaaccatatcaagattaatcgtcaaaacaagcgttttggctccctggcgcgcggatgcgagggcagcctcaacaccggcatgcccggcgccgatgacaatcacgtcgtattggcctgcttcataccccatggttttttcctcccttttatttacctaaacaaaattgtgaaaagagctgatcaattaagctttcgtgaacggcatcaccgatgatttcgcccagcagttcccagcaccttgtcaaatcaatttgcaccatatcaatcggaacatcctgttcaatcccgttcagcgcatcatcaatcgcttgctttgcctgatgcagaatcgaaatatgacgggtgttgctgacataggtgagatctccgctttcgatcgctcctgtataaaatagcgactgaatcgcttcctctaaatcttgaatgccttcttctttcagcaatgaggtcgtgacgacaggccggcctttcgccagttccttgacgcgctcagcgtcaatcttagcctcaaggtccgtcttattcataatgacaatgacgtccattccctcaaccgcttcaaacaatttcacatcttcttcagaaagcgcttcgctgtggttaagcacaagcaaaatgagatccgcttccttcagaacctgccgtgaccgttccacaccgattctttcgacgatgtcttctgtctcacggattccggcggtatcgacaagccgaagcggcacgcctcgcacgttgacatattcctcaatcacatcacgcgtcgttcccggaatatcggttacgatcgccttcgtttcatggacaaggctgttaagcagagaggatttcccgacgttcggacggccgatgatcacggtagacagtccctcacgcaaaattttcccctgctcagacgtacggagcagcgcctcgatttctttcttcacgccgcttgccttctccactaaaagctgatgcgtcatttcttcgacgtcatcatattccggataatctatatttacctcaacatgggcaagtgtttctaacaactcatcacgcagacggcggacaagcgcggaaagccgtccttccatctggttcatggcgacattcatggcacggtccgttttggctctgatcagatccatcaccgcttccgcctgtgaaaggtcaatccgtccgtttaaaaatgcgcgcttcgtaaactcaccgggttctgccagtctcgcaccttctcttaaagcaagctggagcacctgattaaccgtcacaatacccccgtgacagttgatttcaatgacatcttcccttgtgaatgttctgggcgctcttaaaacagacaccatgacttcctcaataatccgtcccgtcgtactgtccgcgatatgcccgtaatgaatggtatgcgattctgccgaactgagcgttttgcctttcggacccttgtacattttgtcggcgatctttacggcttccgggccgctcagccgaacgatcgcaatcgcgccttcacccatcggagttgaaatcgctgcaattgtatccatactgttcacctctctttatctctgtttccatctatataaaaaattttatttacgccaaaattaaaagataacatagtttggtttgaagtggaagatacgttatccacaaaggcagaaattcatcccttattactttaacttatccacatgtgaataacaattaattttatttcctaaaaccttttttatcaacagcatagacctaaaaagaaaaaacttaaacgcaaaaaatgcgattctgctcaggaatagagccatttttaccaataaaaaaaccgaagttccgattttacccggacttcggttttctgctatctttatgggaaataacgagatggcggtaccggccttcaccggtagaaaacgttttgatatttggatgctttgacagcgcgtcatggatgatttttctttcacctgacggcatcggttctaaatgcacctcttttttcgttttcgacacttgcttggccagcctgtttgccagctgatccagaatttctcttcttttccgccgataattttcagcgtcgacaacggcttggcgatactggccggagccgcggttcaaaacaagctgcgtcaatgtttccaaggcattgagtgtttgtcctcttttgccaataagcagcgccgctttttcacctttaatatgaaaacagactgttttcttgttttcttccgtaacaatctcagaaggcccggcaatggaatggatgatttcttctaaatacgctttcgcttcctgaacaggatttcttttctcttccagttctacaatcgcattcttttttccgaaaatacccaaaaaccctttatattcttcttgcaccaccgttatttctacttgatctttcgtcagttgaagttcctgaaggcctgattgaactgcttcttcgacattccgtcccgcagcagtcaccttcttcactttttctttcctccggctttctgcgtttccggatcgtgtttaatgtcaggtcctttaataaggaatgtctgagcaatcataaacaggtttccgactacccaatacagagaaagcgcgctcgggaagttgatcgcaaatacgatgatcatgatcggcataatccataccatcattgccatttgaggattctgagtcggatttcccgccatcatcagcttctgctggacaaaagtggccacaccggcaacgataggaagaatatagtaaggatccttctctcctaaatcaaaccataaaaagctgtgctgtgaaatggcttgcgtacgcataatggcgtggtagaatccgatcaaaatcggcatttgaatcaggatcgggaaacatcccgccagcgggtttaccccgtgctttgaaaacagggccattgtttcctgctgaagcttctgctgcgttttttgatctttagagctgtatttttctctgagcttctgcatttcaggctgcagcgcctgcatcgcttttgagcttcgaagctgcttgatcatcagcggcagaatcagcagacgaattaaaatcgtaacgatgatgatcgacaaaccatagttatcgcccgtcagtttcgctacgtacgtaatgacttctgacaatggatacacaacatatttgtcccagaaatgcggactattcgccgtaatcggctctttcacactcgagcacccggccagcagcacgagcataccgaccatactcagtagtaaccatattctccttttcaagaacgtttcctcctataccaatctttataaaccttgtatgtattttagcatctttcagtttcaaatggcgttcatttttcgccaaataaaaggaagcgcttttaaaaacgtgaagaaaacaaaatatgagctattttgacgaagatttcttatataatgaggtttttctgaataagtgctgcagactctttttcgtttcttcaaaactgaggtcgccggcgggttttcttgcgataataataaaatctttcggcttgagcagctctttttcctcctgaaccgcctgcctgattaaccgcttcacccgattgcgcacgacggcattgccgatttttttactgacagaaagccctacccggagctcttcctgtttcggctgatcaagcgtatacagcacgaactggcggtttgccatagacgttccgcgtttaaacactttttgaaaatcttcatttttctttaaccgatttcgcttcttcactttaattcactccgatattcactcgcagaaacttttatttctatctaaaaaaaacgggccgccggaatactgaagaaatttctccagtaccgggcgacgcatgacatctcttttctcttaatgtgaaaaaagaccactgacattattcagtggcctaagctgataatacttttctgcctttgcggcgacggcgtgctaatactagacgaccgttttttgaactcatacggcttctgaagccatgaactttactgcgtttacggttattcggttggaatgttcttttcatttatgacacctccctcgaggaatagctgttaaagacagtcttacttattatatttgtgctgcctattcattgtcaacttcagcagtgcttttatttcttacaaccataataggataacataccttaaccagattagaaaccttatttttcatattcctttttttaacgcacaaaaaaagccgcgctcccccgaaaaaacgacatgtggataatttttcggtctttttttaatatccacaatcgttatcgacaacattttcacattgctaacccctgtggacaaagatttttcaacaagttgtcaggtttgtggataagattacgagaaccattgcaagtcctcgcttaatttgatattatatttgtgttttaactcttaattacttatccagtccattctctttatccacaaattgtggataagttgtggattgttttcacacagcttgtgtagattgttgtccacaacttgtggaatttgtcgaaaagctatttttctactatactatatgttttcaacatttcgtgtgtacgaatggtcagagccatatgctctttttttgtgttctataacaggggaagggcgctgatttttaaagaaaaggagggctgtgccggataatggagaatatattggatctttggaatcaagctctagctcaaattgagaaaaagctaagcaaaccgagtttcgaaacttggatgaagtcgacgaaagcccattcgctgcaaggagataccttaaccatcaccgctcccaatgaatttgccagagactggctggagtccaggtacttacatctcattgcagataccatatatgaattaaccggggaagaattgagcgtcaaatttgtcattcctcaaaatcaggacgaagaagactttttgccgaaaccgcaagtgaaaaaagcggcaaaagaggaaccgtctgattttccccaaagcatgctcaacccgaaatatacattcgacacattcgtcatcggatcgggaaaccgattcgcccatgcagcatcactggctgtggcggaagcacccgctaaagcgtacaaccctttatttatatacgggggagtcggtttaggaaaaacccacttaatgcacgcgatcggccattatgtcattgatcataatccttcagccaaagtggtgtacctgtcttctgaaaaattcacaaatgaattcatcaactcaatccgcgataataaagccgttgatttccgcaaccgctaccggaacgttgatgtacttttgatagatgatattcaatttttagccggaaaagaacaaacacaggaagagtttttccatacattcaacacacttcatgaagaaagcaaacaaatcgtgatttccagtgacagaccgccgaaagagatcccgacccttgaagaccgcctgcgttcgcggttcgaatggggattgattacagacatcacaccgccggatctggaaacgcggattgccattctgagaaagaaagcgaaggcggagggccttgatattccgaacgaggtcatgctttacatcgccaatcagattgacagcaacatccgcgaactggaaggggcattaatccgggttgtcgcctattcatccttaatcaataaagacattaacgcagacctggctgcagaagcattgaaagatattattccgtcttctaagccgaaggtcattacgataaaagagattcagcggattgtcggacagcagttcaacattaagcttgaagatttcaaagcgaaaaagcgtacgaaatcagtggctttcccaagacaaattgcgatgtatctttcaagagaaatgacggattcttctttgcctaaaatcggggaagaatttggcgggagagaccatacaaccgtcattcacgcccacgaaaagatttcaaaactgctgattgatgacgagcagcttcagcagcaggtgaaagaaataaaagaactgcttaaataatagtgtcctcggatgaatcggggaaagtgtgaataactttttcatagccatacacagtctgtccacatgtggataggctgtgtttcctgtctttttcacaacttatccacaaatccacaggccctactattactactgctatttttaaaaatatattaattatattatccgttaggaggataaacatgaaatttacgattcaaaaagatcggttagtcgaaagtgtacaagacgttctaaaagccgtttcatccagaaccacaattcccattctcaccggtattaagatcgtcgcctcagatgaaggagtatctttcacaggaagtgactctgatatttcaattgagtcattcattccgaaagaagatgatgataaagaaatcgtgacgatcgatcagccgggaagtatcgtgctgcaagcgcgtttcttcagcgaaatcgttaaaaaactgccgatggcgactgttgaaatcgaagttcaaaatcaatatttaacgattatccgttccggaaaagccgaatttaatttaaacggccttgatgcagatgaatatccgcatctaccgcaaatcgaagagcatcacgccattcagattccgacggatcttttgaaaaacctgatccgccaaaccgtgttcgctgtgtccgcctcagaaacacgccccatcttgacaggtgtaaactggaaagttgaaaacggtgaattattatgcactgccacggatagccaccgactcgctttaagaaaggcgaagcttgatattccggaagacagtacttataacgtggtcattcccgggaaaagcttaaccgagctaagcaaaattcttgatgacagccaagagctggtggatatcgtcattacagaaacccaagttctgttcaaagcgaaaaacgtattgttcttctcaagattgcttgacggaaactatccggacacgaccagcttaattccgcaggaaagcaaaacggaaatcgtcgtgaacacgaaggaatttttacaggcgatagaccgtgcttctttattggcgagagaaggccgcaacaacgttgtaaaactttctgccaaaccggcggattcgcttgagatttcatcaaattctccggaaatcgggaaagtggtcgaagctgtgctggcagacaagattgacggcgaggaattaaatatttcattcagtccaaaatatatgatggacgcactgaaagtacttgaaggagcggacatccgtatcagctttacgggagcgatgagaccgtttcttatccgtacgccgaatgatgagaccatcgttcagctcatccttccggtcagaacgtattaatcaaacagaatgtgctgccggcttagttcggcagcttttctattcatcagccgctccctcaagttttccctttccttatttcaggattttttagtacaattagatattagtgatatttgaaagaggtcgatattatggcaaatccgatttcgattgatacagaaatgattacgcttggccagtttttaaaattagctgatgtgattcagtccggcggcatggcgaagtggtttctgagcgagcatgaggtgactgtcaacaatgaacctgacaatcgccgcggcagaaagctttacgttggagacgtggtcgcgattgaaggatttggttcatttcaagtcgtcaattaaagcgggtgacagcggttgtatatccaaaatttagaattaacatcctaccgtaattatgagcgcgctgagcttcaattcgaaaacaaggtgaatgtgatcatcggggaaaatgcccagggcaaaaccaatctgatggaagccatctatgtcctttcgatggcaaaatcacaccgcacctcaaatgacaaagaacttatacggtgggacgaagactatgctaaaatagaaggaagagtgatgaagcgcaacggggacatcccgatgcagcttgtcatctccaaaaaaggtaaaaagggcaaggtcaatcatatagagcagcaaaaactcagtcagtatgtcggagcgctgaacaccattatgtttgcccctgaggatttaaatctcgtcaaaggaagccctcaggtgaggagaagatttctcgatatggagatcgggcaggtttctgccgtttatctgtatgatttatctctttatcaaaaaatcctttcacagcggaatcattttctgaaacagctgcaaagccggaaacagactgaccggaccatgcttgacgttctcactgatcagctgattgaagcagccgcaaaagttgtcgccagacgtctgcagtttacggcgcagcttgaaaaatgggcgcagccgatccattccggcatttcccggggacttgaagaactgacgcttaagtatcacacggcgcttgatgtatcagatcccaaagatttgtcgaaaataggtaacagctaccaggagtctttttcgaaattaaaagaaaaagaaatagaacgaggcgtcacattattcggaccgcatcgggatgatgtccttttttatgtgaacggacgcgatgtgcagacttacggttcgcagggacagcagcgtacgacggctttgtctctaaagctggctgaaatagatttgattcatgaagaaatcggagaataccccattttacttttggatgatgtactaagcgagctggatgattaccgacagtcccatttgcttcatacgatccaaggccgtgtgcagacatttgtcaccacgacgagcgtggatggcattgaccacgataccttacatcaagcaggaatgttccgtgtggaaaacggtgcgttagtgaagtgaagaaatgaggtgagcgattgtatattcatttaggtgacgactttgtcgtttcaacccgcgatatcgtcggcatttttgactgcaaggtcaatgtatcgccgatcgttgaagaatttctggacagacagaaagaaaaagtagtgccgtccgtaaacggcacgccaaagtctatcgtagtcacgactgagaatatatattactctcccttatcttccggcacactgaagaaacgtgcgcaatttatgttagaaatagattcttagcggatctttacaatgaatatattatcgtttaagaaaagtgtaggtgaatgtgcatggctatggaacagcagcaaaatagttatgatgagaatcagatacaggtattagaaggtttggaagctgttcgaaagagaccggggatgtacatcggatcaactaacagcaaaggccttcaccatttggtgtgggaaatcgtcgacaacagtattgacgaagccctggccggttattgtacagatattaacatcgagattgaaaaagataacagcattaccgttaaggacaacgggcgcggaattccggtcggtatccaggagaagatgggccgccctgcggttgaagtcatcatgaccgttctccacgccggcggtaaatttgacggaagcggatataaagtatccggcggtcttcacggtgtaggggcatccgtcgtaaacgccttgtcgaccactcttgacgttacggttcatcgtgacggaaaaatccattatcaggcgtacgagcgcggtgtacctgtggccgatcttgaagtgatcggcgaaactgataagaccggaacgattacgcacttcgttccggacccggaaattttcaaagaaacaactgtatatgactatgatctgctttcaaaccgtgtccgggaattggccttcctgacaaaaggcgtaaacatcacgattgaagacaaacgtgaaggacaagaacggaaaaacgagtaccactacgaaggcggaatcaaaagctatgttgagtacttaaaccgttccaaagaagtcgttcatgaagagccgatttatatcgaaggcgagaaagacggcataacggttgaagttgcattgcaatacaacgacagctatacaagcaatatttattctttcacaaataatatcaacacatacgaaggcggcacgcacgaggccggatttaaaaccggtctgacccgtgtcataaacgactatgcaagaagaaaagggattttcaaagaaaatgatccgaatttaagcggggatgatgtgagagaagggctgactgccattatttcaattaagcaccctgatccgcaattcgaagggcagacgaaaaccaagctcggcaactccgaagcgagaacgatcactgatacgctgttttcttctgcgctggaaacattccttcttgaaaatccggactcagcccgcaaaatcgttgaaaaaggtttaatggccgcaagagcgcggatggcggcgaaaaaagcccgggaattgacccggcgcaaaagtgcgcttgagatttccaatctgccgggcaaactggcggactgttcttctaaagatccgagcatttccgagctgtatatcgtagagggtgactctgcgggcggatcagcgaaacagggacgggaccgtcatttccaagccattctgccgctgcgcggtaagattctgaacgttgagaaagccagacttgataagattctctcaaacaatgaggtcagatcaatgatcacggccctcggaacaggaatcggagaagattttaatcttgaaaaagcgcgttatcataaagtggtcatcatgacggatgccgatgttgacggcgcccatatcagaacgcttttattaacgttcttctacagatacatgcgggaaatcatcgaaaacggctatgtctacattgcccagccgccgctttataaagtgcagcagggaaaacgggtggaatacgcttataacgataagcagcttgatgagctgttaaaagagcttccgcaatcacctaagcccggcctccagcgttataaaggtcttggagaaatgaacgcgactcagctttgggaaacgacaatggaccctgcgaccagaacgcttctgcaagtcaatcttgaagatgcaatggacgctgacgagacttttgaaatgctgatgggtgacaaagtagaaccgcggagaaacttcatagaagcaaacgccagatacgtgaaaaatcttgatatttaaccaagaaagccttattttcgttaagaaataaggcttttttctcaaagcggcttctaaagcctctgaaaacccgcaaaacccgtatattctactaaattaatgtgtataaacacaagtttattgatataatggagaatagtgaaatcgtattgaagatcataatggacaatctactcccacattatttcatgtgatacttcagggaggtttttttaatgagtgaacaaaacacaccacaagtacgtgaagtcaatatcagtcaggaaatgcggacatccttcctggactatgcaatgagcgttatcgtatcccgggcgcttccggatgtgcgtgacggtctgaagccggttcacagacggattttgtacgcaatgaatgatttaggcatgaccagtgacaaaccatataaaaaatctgcccgtatcgtcggtgaagttatcggtaagtaccacccgcacggtgactcagcggtttacgaatcaatggtcagaatggcgcaggattttaactaccgctacatgcttgttgacggacacggcaacttcggttcggttgacggcgactcagcggccgcgatgcgttacacagaagcgagaatgtcaaaaatcgcaatggaaattctgcgtgacattacgaaagacacgattgactatcaagataactatgacggttcagaaagagagcctgccgtcatgccttcgagatttccgaatctgctcgtaaacggggctgccggtattgcggtcggaatggcgacaaacattcccccgcatcagcttggggaagtcattgaaggcgtgcttgccgtaagtgagaatcctgagattacaaaccaggagctgatggaatacatcccgggcccggattttccgactgcaggtcagattttgggccggagcggcatccgcaaggcatatgaatccggacggggatcaatcacgatccgggctaaggctgaaatcgaagagacttcatcgggaaaagaaagaattattgtcacggaacttccttatcaggtgaacaaagcgagattaattgaaaaaatcgcggatcttgtccgagacaaaaaaatcgaaggaattaccgatctgcgagacgaatccgaccgtaacggaatgagaatcgtcattgagatccgccgtgacgccaatgctcacgtcattttgaataacctgtacaaacaaacggccctgcagacgtctttcggaatcaatctgctggcgctcgttgacggacagccgaaggtactaagcctgaaacaatgtctggagcattatcttgatcaccaaaaggttgtgatccggcgcagaacggcttacgaactccgcaaagcggaagcaagagctcacattctggaaggtttaagaattgctctcgatcatttagatgccgttatttctcttatccgcaattcccagacggctgaaattgcgagaacgggtttgatcgaacaattctcactgactgaaaaacaagcgcaagctattctggatatgcgccttcagcgattaaccggtctggagcgcgaaaagattgaagaggaatatcaatcacttgttgcgcttatcgctgagctgaaagatattttagccaatgaagaaagagttcttgagatcatccgtgaagaacttaatgaaatcaaagagcgtttcaatgatgagagacgcactgaaatcgtgacgtccggtcttgaaacaattgaagatgaagatcttatcgagagagaaaatatcgtcatcacactgacccataacggctatgttaaacgtctcccggcgtccacataccgcagccaaaaacggggcggaaaaggcgtacagggaatgggaacgaatgaagatgactttgtggaacacttaatttccacatcaacgcacgatacgattctgttcttctctaataaagggaaggtataccgttctaaaggatatgaaatccctgaatacggccgtacggcaaaaggcattccgattattaaccttctggaagttgaaaaaggcgaatggattaatgccattattccggtcagcacgtttgatgaggagcaatacctcttctttacgaccaaacaaggggtgtcgaaacgtacggcactgtcccagtttgcgaatatacggaataacggtctgatcgccctaggtctccgggaagacgatgaactgatggccgtccgcctgactgacggcaagaaacaaatcatcatcggaacgaagaacggtttgctgatccgtttccctgaagaagatgtaagacaaatgggacgcacagctgcgggtgttaaaggtatcacgctgacagacgatgatgtcgttgtaggcatggagattcttgaagaagactcccatgtcctcatagtgacagaaaacggctacggcaaacgcacaccggcttcagaatacagagttcaaagccggggcggaaaaggccttaaaacatgtaaaatcactgacagcaacggtccgttagtaactgtgaaagcaacaaaaggcgaagaggacttaatgattattacggcaagcggcgtgttaatcagaatggatattaatgatatctccactacgggacgcgtaacacaaggcgtccgtctgatccgcatgtctgatcaagagcatgtagccactgtggcgcttgtcgaaaagaatgaagaagagccggaagaaacggaagaagtataaacgaaaaagcgcagctgcaacaggctgcgcttttactatataaagaaataaaaaaaagctttgacacatggtgatgatgctgatataattctttttgttgtctttttaatagaaaggcaagcctagcgaaaatattttttaaaaaagtattgacctagcaaactgaaaatgttatgattaagaggtcgcttcgagaggggcggaaaagttctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtcccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggaactttgattctttcatatggtagatgggcctgtagctcagctggttagagcgcacgcctgataagcgtgaggtcggtggttcgagtccactcaggcccaccatctttacccaatacggggccttagctcagctgggagagcgcctgctttgcacgcaggaggtcagcggttcgatcccgctaggctccaccaacgtgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatacttattgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctatcattacggtaaaggcagctcatcatgagctgccttttttgtttacaagtattgcttcaggaatttagaaacgtaatacggaaatttgcgttccgtgacctctaagaaccgtcggatcatcacataatcatcactgacatgctgtgtcagcagttcataccaccactccgtttcatatctcgcaatcatcccaatattgtagagaaccaaataatgaataatcatttccggaagatgcaggaagtgatcacgctgagagggaatgtaatattgatttttctccaagtgaaacaataaatttggagaagaccaaggttccctgtctatcgggtcagcctcaaaaaacaagtggttatggtctttcctcagaaaagaccacttcaaatgatggctgatatattcagcaaagcgggaatcagacatattgtaatgaatcaccgcatgctcaggcactgaaataaggtcatcgttcagctctacttgggtcatccaattctttttctcttggaagtaaaagacagtatgcaattcaggtatggctgtcagtaatttcttcattgtgtaccgttcttcctcaagaccagctatcccgaataagtgcttcattacatgaatacataagccattgcgctgcaccttcacttcatcatccctaaaggagtaattttgctttttgcgtttccgggcagtcacgccatgcgcgagtactgaagcgtggcttgggtagcttggatctgtggtcagaaggcaggctttcagcaattgtgacatcccgtaaaacaacagaataggcttaatttctaaaggagaaagagatgcctgcttataaaaggactcggcgtgtttgataaagaatatgaagcgctcactgttcttaaacgcatatcgttttggttcttccatgccgctttctgtatagactttgtttagaaatttctgggaagattctacggaataaaataatgataactctttccactcatgatctctcatatgtatttttaaaccctttcctttatctaaatatttcaactctttttcgcttccttgacatgctgttttctagttgataatctacatataatattttgccgaaaagagggggatttactaatgtgggaaagtaaattttcaaaagaaggcttaacgttcgatgatgtactgctcgtaccggctcaatcagacgtacttccgcgtgatgtggatttatctgttgaactgacaaaaacgttaaagcttaatattcctgtcatcagtgcgggaatggatacagtaacagaatcagcaatggcgattgcgatggccagacagggcggcttgggcattatccataaaaacatgtccatcgaacagcaggctgaacatgttgacaaagtcaaacgttctgaacggggcgttattacaaatcccttctttttaacacctgatcatcaagtattcgatgcggagcatttgatggggaaatacagaatttccggtgttccgatcgtagataataaagacgatcaaaagcttgtcggtatcattacaaaccgtgatcttcgctttatctctgattattcaatgaaaatcagtgatgtcatgacaaaagaagagctggttacggctcctgtgggaaccacattagacgaagcagaaaaaatcttacagaaacataaaattgaaaaacttccgttagtggatgaccaaaacaaattaaaaggtcttatcacgatcaaagatattgaaaaggttatcgaattccctaattcatctaaagatgaacacggacgccttattgtcggcgctgcggtaggcgtgacaggcgatacaatgacacgcgtcagcaagcttgttgaagcgaatgtcgacgttatcgtggttgatacggctcacggacattccagaggcgtactgaacacagttgcgaaaatccgtgaaacatatcctgaactgaacattatcgcaggaaatgttgcaacggctgaagcgacaaaagctctgattgaagccggagcaaatattgtcaaagtgggaatcgggcctggttctatctgtacgacacgcgtcgttgcaggtgtaggcgtaccgcagatcactgccatttatgattgtgccactgaagcgagaaaacacggcgcgacaattatcgcagacggcggtattaaattctccggagatattacgaaagcgttggcttcaggcggacatgccgtaatgctcggaagcctgcttgccggtacttcagaaagcccgggagagactgaaatctatcagggcagaagatttaaagtgtatcgcggtatgggttctgttgctgccatggaaaaaggcagtaaagaccgatatttccaagaagaaaataagaaattcgtccctgaaggtatcgaaggacggactccgtacaaaggtcctgtagaagaaacagtgtatcagcttgtcggcggtcttcgttcaggtatgggatattgcggttcaaaagacttgcgcgctttaagagaagaggctcaattcatccgtatgacaggtgccggtcttcgcgaaagtcatccgcatgatgtccaaattacgaaagaatcaccaaactacacaatctcataattgttacaaataaaaaacatttgacagggtcgctgactctgtctattttttttatatcgagtgtgataaaatttatactgttgtgttttgaatttgaatatgtccttaacggcttaattatagatttaaaatgaatgacggaggtcgtaagattgaacatcacgaaatggaaacagctgttggtgtcattagtggtactggcactggccgcaacttgctttgttccgatgtctaaagcggaggcagccggcaatgacccgattgatgtcaacgcatcagctgcgataatgattgaggcttcatcgggaaaaattttatacagtaaaaatgcagacaaaagactgccgattgccagcatgacaaaaatgatgactgaatatctgcttctggaagccattaaagaaggaaaagtgaaatgggatcaaacgtatactcctgatgattatgtctatgaaatttctcaagacaacagtttatcaaacgtcccccttcgaaaagacggcaaatacacggttaaagaactgtatcaggccatggcgatttactctgctaacggagccgcgattgcagttgccgaaattcttgccggaactgaaacgaaatttgtcgctgaaatgaatgcgaaagccaaagaattaggcatgacaaactatgattttaaaaatgccacagggcttgtgaatgaagatcttcacggcaaacagccgcaaggagaaggcgttaaagaagagagtgaagtttctgctaaagacatggcgcttcttgcagaccgcctgatcactgattatccggaagttctcaaaacaacaagcatcgctaaaacgaaattcagagccggcactgatgatgaaatggacatgccgaactggaacttcatgttaaaaggtcttgtttctgaataccctggcgttgacggcttaaaaacgggttctactgattctgcgggatcttgttttacaagcacagcacagcggaacggaatgcgggtcatcaccgttgtattaaacgcaaaaggcaacctgcataccggacgttttgatgaaacgaaaaaaatgctcgattacgcatttaacagcaatttctcaatgaaagatctttaccctgaaggctctcaagtaaaagggcacaaaacggttgacgttgaaaaagggaaagacaagcaagtcgatattgttactgacaaggcgctttctattcctgtgaaaagcggggatgaaaagaactataaagccgaagggactatagataaaaaagaaatcacggctcctgtgaaaaagggaacgaaagtcggaacgctgacagttacatacaaaggcagtgacaaagactatggcttcctcaaatccaaagagttcagcgtgaatcttgtaacgaaaaatgatgtagataaagcaaactggtttgttcagatgatgcgcggcatcggcggatttttctccggtatctggaacagcgccgttgacacggtaacaggctggttttaagaaataagaaagagctctgatgaaagttagggctcttttgcttaatatactgaaaaaaccaaattattagtaaaaaaatgatatctatcttattcatctcgctgtaaaataagaatacccatatgaaatattgtatttctgggatacaataagagatagacattatctaactatacattgactagggggaccaaataatggctcaaacaggtactgatcgtgtaaaacgcggcatggcggaaatgcaaaaaggcggcgtcatcatggacgtagtaaatgctgaacaagcgaagattgcggaagaggcgggagctgttgccgtaatggcgttagaacgcgttccggctgatattcgcgctgccggcggtgttgcccgcatggctgatccgacaatcgttgaagaagtaatgaatgctgtatccattcccgtaatggcaaaagcgcgtatcggacatatcgttgaagcgcgtgtccttgaagcaatgggagtagattacatcgatgaaagtgaagttctgactccggctgacgaagaatttcatttaaataaaaatgaatatacagtcccgttcgtatgcggctgccgtgatctcggcgaagcaacgcgccgtatcgccgaaggagcttccatgcttcgtacaaaaggcgaaccgggaacaggaaacattgtggaagctgtccgccatatgagaaaagtaaacgcgcaagtgcgcaaagttgttgcgatgagcgatgatgagctgatgactgaagctaaaaacctcggcgctccttatgaactgcttcttcagatcaaacgtgacggcaaactgcctgtagtgaactttgctgccggcggagtagcgacgcctgctgacgcggcattgatgatgcagcttggcgctgacggcgtatttgtcggttcaggtattttcaaatcagacaaccctgctaaattcgccaaagcaattgttgaagcaacgactcattatacagactacaaactgatcgctgagctttctaaagaattaggcacagcaatgaaaggcatcgaaatctcaaatctattgccggaacagcgtatgcaagaacgcggctggtaaaaccataggagagctgtaagcatgttaacaattggtgtacttggacttcaaggagcagtaagagaacatattcgttcaattgaagcatgtggttcaaaaggtgtcgtcattaagcgtcctgaacagctgaatgacatcgacggcttaatcctgccgggcggggaaagcacgacgatgcggcgtttaatggatacgtatcattttatggagccgcttcgcgagtttgccgctcaaggcaagccgatgttcggcacatgcgccggtctgattatcttagccaaagagatagcgggaacggataacgctcatttagggctgttgaacgtagttgtcgagcgtaattcctttggccgtcaggtcgacagctttgaagctgatctgacgattaaaggccttgatgagccgtttacgggtgtatttattcgcgcaccgcatattttaaaagccggagaagatgttgaagtgctttgtgagcataacggacgcatcgtggctgcaaagcagggaaatttcctcggctgctcgttccatcctgaactgacggatgatcaccgggtgacagagctgtttgtgaagatggcggaaaagcataagcaggaaacagctgtataaaacagttgaaaaccgctgatacttatagtacattataatcacaaataaagatcgaaaagcgttgacaggaagcagtaggaagcccctctttcaaagagagccgatgggtggtgcgaatcggtgaaagatgctgtccgaatccgtccttgagcgaaatgctgaaaacaagtaggcatttacgggaaaaccgttatgtgttaaagcggaaagcaagtgtgagcttgttttcaatcagggtggcaacgcgagagctctcgtcccttttaggggatgagggctcttttttattttcgataaaaacagataggagttgttaggcatgattgatacgaaggtgctgagagccaattttcaagaggtaaaagcgaagctcattccaaaaggcgaagacttatctgactttgacaagtttgaagagctggatgaaaagagaagagagcttatcggtaaagtagaagaactgaagggaaaacgcaatgaggtgtctcagcaggtcgccgttttgaaacgggagaaaaaagacgctgatcatattattaaagagatgcgtgaagtaggcgaagaaattaagaagcttgatgaagagcttcgtactgtcgaaacgacgctcgaaaccatccttctgtctattccgaacatcccgcacgattcagttcccgtcggagaaacggaagatgataacattgaaattcgcaagtggggagaggcgccggcattttcatatgagccgaaaccgcattgggatatcgcagaccgcttaaacattcttgatttcgaacgcgcttcaaaagtaacaggcagccggtttgtgttttataaaggattaggcgcccgcctcgaacgcgcgctctacaactttatgctggatcttcacgtggatgaatatgattacacggaagtcattcctccttatatggtaaaccgtacgagcatgacaggtacgggacagcttcctaaatttgaagaggatgcttttaaaatcagagaagaggattatttcttaattccgacggcggaagtgccgattacaaatatgcaccgcgatgaaatcttatccggtgagaacctgccgatcaattatgccgcgttcagcgcctgcttccgttcagaagcgggatccgccggccgtgatacacgcggtttgatccgtcagcatcagttcaacaaggttgagcttgtaaagttcgtgaagccggaagattcttatgaggagcttgaaaaactgacaaatcaagctgagcgggtgcttcagctgcttgaactgccgtatcgcgtcatgagcatgtgtaccggtgatctcggctttacagctgcgaaaaagtacgatattgaggtatggattccaagccaagacacataccgtgaaatttcttcttgcagcaactttgaggccttccaggcaagacgtgcgaacattcgtttcagacgcgaagcgaaaggcaagcctgagcatgtgcatacattaaacggttcaggtcttgcagtcggcagaactgtagctgccatcttggaaaactaccagcaggaagacggaagtgtcatcattcctaaagtgcttcgtccttatatgggaaataaagaagtcatcaaaccataaaaaggtgcgccctagaggcgcgccttttttgctgcccggtatagagcggcggcattccgggctgtactttccaggttaaaacggccggatgctaaggcgtcttcaagacttacagcgccgggcacgatagaaaatacagctgttattcctgcgctgtaaacatgctcaaaatttttgcctaaggagcccgccaatgcgataacgggaatttcttgagcggctgcgcgtgcggcgatcccggcgggggttttgccgaatatcgtttgtccgtcaatctggccctctccggtaatgacaaggtcagcatctcttatctgatctgagaaggacagtgtatctaatacaacgtcaatcccgctttgaatttctgcctgtaagaaagcgatcagtccagcgcccagcccccctgcggcgcccgcgccttttacggtatccgcttcgatatcgtgctgacgtctcaatacgtcagcgaaatggtataaattgcgatccaatacaactttagtcttctcggacgcccctttttgcgggccgaagacatatgacgcgccgttttcaccggtcaggggattttcgacatcacatgcggcacgaaaacggatatgtttcagatcaggggagagcccgcttatatcaatagaagctagggtgtgcagagcgcctcctccgtcatgtatctcctgaccttcctcatttaagaaacgcacaccgagcgcgctcgccattcctgttccgccgtcattggttgcactcccgccaagcccgatgatgatctcactcgccccgcgggaggctgcatccgctatcagttcacccgttcctcttgtcgttgtgttcaacggatctctgagatggcggggaacgagatggagtcccgatgcttccgccatttcaatgactgccgtgcgtccgtctcccagaagtccatatgcggcgtttaccggcgttcccagcggaccggtcacagtttttttgatgatgcttccgccagtggcatccgtcaaagcctgaacggttccttctccgccgtcggccgcgggtatcttggtatattccgcgtcagggaagaccgctttgaatcctttttctatgctgtcagcggcttcttttgatgtcatgctttctttgaaagaatcgggtgcgatgatgattttcattatgttctccacctttatgagcaggttatctgtttgaatctattcttgatttttactttgttttcctgcccgtatggcatactgaggttgaattggacgcaagacttttgtatgatagtaaagctgacggaaaagctgtttaagaaatgaaataaaaaatatgaaaaagcgcttgactgaaatttgggtcatgtggtatattattaaatgtcgatacggaggaatacccaagtctggctgaagggatcggtcttgaaaaccgacaggggtgtcaaagcccgcgggggttcgaatccctcttcctccgccatattgattttaaacctaatgaaactcgagcatatattggagattgttttgtccgctgcatctgatgcagcggattttttatatgcaaaaaaagcgattttctctgttcggggaaaatcgctttgctatttttatttgtttctgttttcgctgatcacgtgactgattttttcgatcaaaggttccagtgactgttcatcagcttcaaggtcataatcttcaatgcgtactttcagtacagggcaggcgttaaaaccgctgatccagtcttcgtaccgtgtatacatctcttcccaataagagcggtttgtctgcagctccatctcgcggccccgcttttcaatccggcttataatgtattcaaggtcgccttctaagtagatcaaaacatcaggatgcgggaaatacggcgtcatgaccatcgcctcaaataggcttgtgtatgttgtgtaatctgtcagcgacatggttcctttatcggcatgcatttttgcgaatatgcctgtatcttcataaatcgaacggtcctgcacgaatccgccgcctgattcaaacatgtttttttgctctttgaaccgctcagccagaaaataaatttgcaaatggaagctccagcgttcaaaatcgtgataaaacttctctaaataagggttttcatccacttcctcaagtgaggtatgaaacccgagccgttttgctaaagctttggtcaaagtcgattttccgactcctaccgttcccgctactgttataatggcgttgtttggaatatgaatgtctttcatttaataagctcctttacctgacgggcaattctttcatagtctgtcttattcaaaacaaagtcttcagtatcaccgtcaatggtcagtacagatatatccggatcttcttcctgaagctgtctgatggctgtgtcgtaatctgcaatgagatgttccagatattgatgttcgatatttttctcaaacgggcgcccgcgtttttcaatgcgttgaagcaatgtcggcaggcttgcctttatgtatacaatgatattcggcttcggcaggtcgtgagtgagcagatgatagatctgcttatacttctcaagcttttggccgtgcaatgtacgctctgcgaaaataacatttttataaatatgataatcggacaaaacgggctgtccttgttttaaataatctcgatcggtgtcttcaagctgtttatacctgtgacatagaaaaaacatttcaagctggaaactccactcctcgatattgtcataaaacttatcgagataagggttgtcttccacaatctcattaatcataggaaaaccgagctcttcagaaagcatcgtagcgagtgtcgtttttcctgccccgataggaccttctaccgcgataaaaggggctctgttcattgaaaatcctccttaattctgcaaacatccgtcagctgccggcctttatattgtatcacactcacagaaaagcccatgaaaaaagacgctcccaattaacgaaacgtctcttttacaatatgaaattgatcgccgagcaaaagccagttttgcgggaaagaaaggccgagtttccaatagctgattcctcttaaatgaagttctttaattaaattgaatttcgcttgaatggatcgtgcgtcttcaaaccatacttcatgccgtctctgatttgcatccgtgtatcggaagaagggagcctgggcggtttcgtcatattgaatgtcgactttatagcgtgctgccagagcgattgcctgctgaggactgacggctttcgctgtcgttccctgtttgaaaggcagtgtccaatcatagccgtacatattctggcccatgacgatttttgaagaaggcatttccgtcagcgcgtactcaatgacatttcttacagggccgataggtgatacggcctcagccgggcctccgctgtacccccactcatatgtcataatcacgacgaaatcgacgatttctccatgtgccctatagtcatgagcttcgtaccatttgccggcctgagtcgcgctcgttttcggagcaagcgccgttgaaatcttccagccttcccgatgaaaaatcgttctcgcttcacgtaaaaaacgattgtaggcttccctgtcctgtggacgtaaatattcgaaatcaaagtgaatatcgcgaaagccgtactttttagccgtggagacgatttcctgaaagagttttgttttcactgtattgtcgttcaagatgagccgcccgagttcatcgctgaatgcgtcattttcaaggttggtgatgatcatcatcagtgtggtgttgtgcctgtcactgatgctttttaaattggtcagaggcggttcctttaaagtcccgttccgctgcacttgaaaactgaatgcgccgaggtatgttaaataaggagaggcctcccttgccgcctgctgaagattagcgcttacgctcgttccccgcggttctatatatgcgtttgattcgatatcgggcttattcgcctgctgcggaatgtaaaggcgggttccgactctcaatgtggtgccgggctgaattccgttcaccctcgcaagctccgcggccgatatatgaaaacggccggcgattgacgcgagagtatcaccttgttttacttcgtaatattgaccctcaatcgggatgacaagggtttgtccgacaaccaatgtattgggattaggcagtttatttgcttccgcaatgacatttgcggctgtccggtagcgcgccgcaatagcggaaagcgtgtcgccccgtttcactatatagatctgaatgaaaaacgcctcctttcatatccgctatcaaatatatgaaaaaaggaggctgatcatgtttatttttcgccggtaatttgtttttccgtggttatttctgcgaagagaacattctccatcatggtcaaagcgaaatcattgtcttcgtcgttattggaagcggtgcagtctttcggaatggcaatgctgtattctctcatataagcgtcgttggccgtgaacagcacacaaatgttcccggcaatccccgtgatgattaatcggttcacttgtaattcggtcagaagggtgtgaagcgccgtttcgtaaaaagcggaatgcttcggtttaatgagaaaataatcatccggctgaggcgaaatatcttttataatggaggcgcttctgtcgttgctgcattcctccctgatggcatcaatatcagccttccagagcccgtaatgatcattaatataaataatcggccagttgctttgttttgcatgcttctttaatgataaaatacgggggacaatttgtttggttttttcagcaagacgttcgcccatatcaaattgaaaattgttgatcatatcgacaatcagaagggctgtgttgttaggttcagacaataccggcaactcctttctgctggggtattcctattttaacctttatgagacatgaaaaaacttaagaagagagctcgaaccgatgaatgatgaatattatatgagagaagccataaaagaagcgaagaaagccgaagagaaaggtgaagtgccgatcggagcagttcttgttctgcacgatgagatcgtggcgcgggcgcataatctgcgggagactgaacagaggtcgcttgcccacgccgaaatgctggcgatagacgaagcgtgccgtaagctggggacatggagacttgaggatgccgttctctatgtcactttggagccgtgtccgatgtgcgcgggagccgtcgtgctttcgagagtcgataaggtcgtattcggcgcatttgatcccaagggggctgtacaggaacgctgatgaacctcttgcaggaagagcggttcaaccaccaagcggaagtggtgagcggcgtgctcggagaagagtgcggagaaatgctcagcgcttttttcagaaagctgcgccggcaaaagaaagacatgaggaaaaagttgtctgagtagtacggttgcattttctgcctgaagcagatatacttatgtgtgcatcatgaatggtgcgcatatcaaaatttgatatttattttgccgtgctaagcggggaggtagcggtgccctgtacccgcaatccgctctagcggggccgaatcccttctcgaggttcgtttactgtaaggtctgccttaagtaagtggcgttgacgtctgggtcctgcgcaatgggaattcatgaaccatgtcaggtccggaaggaagcagcattaagtgaaacctctcatgtgccgcagggttgcctgggctgagctaactgcttaagtaacgcttagggtagcgaatcgacagaaggtgcacggtaaatcaatcatcaaatttcagactcacctgttatggcaggtgagttttttcgtatatgaaaaacgggttttggcgttaaaagcacgttcatgtataataaacatgatgaataacagaggagggcgcatcctgtgggttaccaagctttatatcgagtatttaggcctcagcagtttgaagatgtggtcggacaggaacacattacgaaaacgctgcaaaatgcccttttgcaaaagaaattttctcatgcatatctgttttctggaccgcggggaacgggaaaaaccagtgcagctaaaatatttgcgaaagcagtcaactgtgagcacgcccctgtagaagaaccgtgcaatgagtgcgcggcatgcaaggggatcacaaatggctctatatcagatgtgattgaaatagatgcggcgtcgaataacggcgtagacgaaatccgcgacatccgtgacaaagtaaaatttgccccgtcggccgttacttacaaggtatatattatagatgaggtgcatatgctctctatcggcgcattcaatgcgcttctgaaaacgctggaagaaccgccggcacattgcattttcatattagctacgactgagcctcataagattcctttaaccattatctccagatgtcagcgttttgacttcaaacggattacatccaaagcaattgtcggacgaatgaagacaatcgtcgatgcagagcagctgaaggtggaagaaggagcccttgatatcatagcgagtgctgcggacggaggaatgagggacgcgctgagcctgctcgatcaagctgtatcattcagcggcgaggagctgtcggtggatgacgctttgctcattaccggagccgtttctcagcactatattggaaaactggcatctgctcttcaccgcaaacaggtttccgaggcattggaaacactgaatgaattgctccagcaggggaaagatgcggccaaactgattgaagatatgattttctatttcagggatatgctcttgtaccaggccgctcccggtttagaaggagtcctggagaaggtgaaggtcgatgaaacgtttcggaatctgagcggtgacataccggcccccgctttatatgagatgattgatatcctgaataaaagccatcaggaaatgaagtggacgaaccacccaagaatcttttttgaagtggctgtcgtgaaaatatgccaaacggcacagcaatccgccggagacatccctgaggtcggcatgctgatgaataagatccagcagcttgagcaggaagtagaaaggctgaaaacctccggtgtgaaggttcagatggaaagcgctccgaaagaagctccgcgtcctcaaaaaggcggaaaaagccattataaagccccggtcggaagaattcatgagatattgaaggaagccacaagacctgatcttgaacagcttaaaagcagctggggcaagctgctggcacacctgaaacagcagaataaggtgtctcatgcggctcttttgaatgacagtgaaccggtggccgctgctcaaaaggcatttgtgcttaaatttaaatacgaaatccattgtaaaatggttgcagaagacaataacggagtccgtacgaatcttgaacagattctcgaatcaatgctcgggaaaagaatggatttgattggcgttccggaagcacaatggggtaaaataagagaagaatttttaaatgatcaccagcaggaaagtgaaggatcaaacgaaccggctgaagaagatccgctgattgcagaggcgaaaaaacttgtcggagcggatttaatcgaaataaaagactaataagatgaaagagagtgattgaatatgcgtggcggaatgggaaacatgcaaaaaatgatgaaacaaatgcaaaaaatgcaaaaggatatggcgaaggctcaggaggaacttgctgaaaaagtgcttgaaggcactgcgggcggcggtatggtgactgtaaaagtcaacggccaaaaagaagttgtagacgttgccattaaagaagaagttgttgatccggaagatatcgaaatgcttcaggacctggttcttgctgcgacaaacgacgccctcaaaaaagtggatgacatgacgaatgagacaatgggacaatttacaaaaggaatgaacataccgggtttattctaggggataaataaacatgcagtatcctgaaccaatatcaaagctgattgacagctttatgaaattgccagggatcggaccgaaaacagcggttcgtctggctttttttgttctaggtatgaaagaagacacagtattggattttgctaaggcgcttgtcaatgcgaagcggaatctgacatattgctcgatttgcggacatattacagatcaggacccttgttatatatgtgaggacacaagaagagataagtctgttatttgtgtcgtgcaggaccctaaggatgtgatcgcgatggagaaaatgaaggaatataacggccagtatcatgttcttcacggcgcgatttcaccaatggacggcatcggtccggaggatattaagattccggagctgctgaaacgtcttcaggatgatcaagtgacagaagttattctcgcaaccaaccctaatattgaaggggaagcaacagcgatgtatatatcaaggctgttaaagccctcaggcatcaagctctcccgtattgcccacggtctgcccgtcggcggtgatttggaatatgctgatgaggtcactctttcaaaagctcttgaaggaagacgtgaattgtaagggaggaaaaggcaaggcatgggttttcttcgcagaaatacattaagaaaagagtttgacgagaagctgatagaacagctctttaaacaaaaagaagaatggaacagacagaagagtctggtcgagaaaagtctagagccctccgctgaggtgttgtttgagctgaaagtcgctgaatctaagtactttttttatttgaaagaagcgaagcagcggaatttgaaaatgagcagatggaagtaagaggtctattctccggaatcttctcataagcttgtactaaacaagcgagggggaagattcatggagccttttttcattatcggtttgattgtcggtctggttgctttgctttttttatggggagtatcttcaaaaccgttaaggtggattggtgtgactgccattaagtttattgccggcgcgattctgttggtgggtgtgaacttgttcgggggcagtctgggtattcatatccctgttaacctgattacaacgggcatcagcggaattcttgggattcccggtatcgcggctttgatagtcattaaacgcttcatcatttaatttgtcgattattgttgacatgttggatcaagggtggtattctaatatacgtcgctgatgacgaaacgaattcttgaaaaagaaattttaaaaagttattgacgacaatgacactgagatgttataataattaagtcgcttcaagagcgatggacaaagttctttgaaaactaaacaagacaaaacgtacctgttaattcaaagttttaaataaatcgcacagcgatgtgcgtagtcagtcaaacactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaaggctgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggaattttgattctttcatatggtagatgggcctgtagctcagctggttagagcgcacgcctgataagcgtgaggtcggtggttcgagtccactcaggcccaccatctttacccaatacggggccttagctcagctgggagagcgcctgctttgcacgcaggaggtcagcggttcgatcccgctaggctccaccaacgtgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactagggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctatcattacggtaaaggcagctcatcatgagctgccttttttgtttttgaataaaaacgaaacaaacaccgaaatacgggaacgcccatatactaattgcaaacttcaaaaagatccaaattgtgtatacaatcaacagtttaagggaaggctattcatacggaggtgggcaaaatgaatgaaacgtccggccatgaagaaacatgtattgtgtgtgaaaccaagaaaagcaggggaatccatatttatacgaaatttatatgtttagagtgtgagaagaaagtagtttccactccgacctctgatccgaattatgaatttttcgttcgtaaattgaaaagccttcatacaccgacgttatattcttaaccctgaaaagggtcttttttttgcctgaaatcagaggagttttttcactttttataaaagaactgatacgataagaagaggaacttgtttagacatggaatgtaatagataatactgataaaagtgaataaataggagtcgatcaagtatgaaaccgtttattcaatatatgaaatggacattttgcggcagcacagtttttgtattagcggggataaccttctttacgatagggcaccagccttttctgtattcgcttttatacggggcggccggcggagccgcagtcagtgcgtccggcttgtggaatgcgaagcgtctctttttaaaaaaacaccggctgacaagaaaagaatatgcttatatcaaggaaaatctcgaggaagcaaagggtaaaatcatccgattacgcagggcgcttttccgctctaaaagtatacaaatgctgaagcagaatgcagagatactgcggataacccgacgaatatatctgctcacaaagcaggagccgaagcgtttttatcaggcagagcgtttctattatcaaacgcttgattctgttgtggaactgacggaaaagtatgctttgctctcatcacagccgcgaaaaaataaagatttatcaatgtccttgagtgagacgaggatgactctggcggagctttccagaaggctggaagaagatcttcatgaactgatgaaggaggacatcgacgacctgcactttgaattagatatggcaaagcattcactgagaaaataagaaaggaagaaggaaatggccaaagaccgttccgacgacagtatgggcgcccaaaatgaccagactcatctaaagcttgcagatacgctgccggaagaaaaaagagaagcggcacttcagctcgctgaaaaactggaccctggaaacatgcaaagcattgttctgtttggttcacaggcgcaggcgaatcttctggaattttcccacacgatgatagagcacgtgcaaagaaaagatgcaggagagatgggacagatattggctgatctgatgctgaagcttgaccaggtaaaccccgatgatctgcaggtaaagaacaaagggtttttcgcccggctgtttaaaagggtatccggatctgtgcaggaagtgctttcgaaatatcaaaagacaagtgtgcagattgaccgtatcagcagaaggctggaacattctaaaaatgtgctgttgagtgacaataaatggttagatcagctgtacgtccaaaataaacaatacttttctgatttaactatgtatatagcagcgggtgaattaaaattagatgagctgaaaacaaagcttattcccgaagtggcaagaaaagccgaattacgaaaacacaatcaaatggccgcacaggaagtgaatgatcttcgccagtttgccgaccgtctggataagagggtgcatgatctgctgctgagcaggcagattacgcttcagagtgcgccgcaaatccgtctgattcaaaacacgaatcaggcactggcagagaaaattcagtcctccattgttacggctattcctttatggaagaatcaagtcgccatcgcgctgacgcttatgaggcagcggagtgcggcagatgtgcagaagaaggcggcggatacgacaaatcaattgctgctgaaaaacgccgaacttctgaaaacaagcacagtcgagacggccaaagccaatgagcgcggacttgttgaggcagacaccctcaaaaaagtgcaggaaagcttagtcagcacacttgaagaaatcatgtctattcaagaagaaggcaggatgaaacgcaggcgtgccgaggaggagcttgttatcatggaaggcgatttaaaaaagaagctgcttgatatgagttccggccgggataacggctagatggcaaaaagtcttagctttaagttggctcgcaggcacgatataataagaaagacaggcaaaggatttgtttaaaaatggacacacctttatatacagcgctgatgaagcatgcgcaccgaaatacgtattcttttcatgttccgggacatcacaatggagatgtcttttttgatgaagcgaaatctgtatatcaatctcttttatctattgatatgactgagatcacgggtcttgatgacttgcatcacccgacaggggtcattaaggaagcgcaggatttggtgagcagattgtacggctctcaggaaagcttctttctcgtcaacggaacgaccgccggcaatctggcgatgattttagctgtttgtgaaccgggtgaacccattctgatccagcgtaattgtcacaagtctgttttccatgcggtggcattggccggagccaagccggtttatttggcgccggaaatcgatgaaaatatgcatgtgccggcacatgtatctctttcagtcatcgaaaaagcgctggcgtcatatccgaacgcgaaaggacttgttttgaccaatccgacttattacggacacgccgccgatttgactgcggcagttaaaaaagcccattcatacggtgttcctgtgctggtggatgaggctcatggagctcactttgtgttagggcagcctttcccgccttcatcattggctatgggggcggacgccgttgttcaatcggctcacaaaacgcttccggctatgacgatgggatcttactttcatttaaacagcacccgaattgacagagatcgattaacttattatgtaagcagtttgcaaagcagcagcccgtcatacccgattatggcatctttagatacggcgcgtgcttatgtgcaggatattgctgaaaaagggacacttcccgtccatatggagcacattgagaaaatcaaacgaaggttcgcatcaatttcttctattgaaataatcgagccttccggatatgggctgcgggcggacccgttaaaattaatacttcggtcaaagctcggacattccggctattcattacaacgcattttggagagtgagggcattgttgccgagctggctgacgagtaccaagtattgctcgtactgtcgataggcggccggcggatgatagaacaggcagccgtaagaaacatacagcagaaactggagaatacaccgcccgataaattgccggatgccgtgaattggacatttccgtccatttcgacacttgaatatccgcaaaatgagatgcggaagtttacaaaagagcctgcagatataaataaggcggccgggcgcttgcatgcggggaacattattccttatccgccgggaattccgctgatcatggacggcgaacggataacagaagagatcgtacagaagctttcccgtttaatcggcatggacgcgcatattcaaggcttgttaaacggggaacaattacttgtctatatagaagaggagaaatcatgagcggtttatttataacatttgaaggtcctgaaggtgcagggaaaacgactgtgcttcaggaactgaaagagattctgtcggcagaggggctcccggtgacagcgacaagagaaccgggcggcatcgacattgcggaacagatcagagaagtgatcttaaataaaaacaatacactgatggatgcaaaaacggaggcgctgctttacgccgcggcgagaagacagcatttaaccgaaaaggtgcagcctgcattgaaagaagggcgcattgtgctgtgtgatcgtttcatcgacagttcgctggcttatcaaggctatgcgagagggctcggcattgatgaagttctttctattaaccagtttgcaatcggcgatacgatgcctgatgtcaccatctatttttctattgagcctgaagaagggttgaaacggattacgtcgaatgattcaagagaaaagaatcgtctcgatcttgaggctctgcactttcacacgaaagtacgggaaggataccaaaaggttatgcagcgttttccggaaagattccatacaatcgacgcatcgaaaaagaaggaactcgtcattcaggacgcacttcaagtgataaatgaagcattgaaaaaaattcagttgtgacctgtttctcataagttgctataatgaatgtaacgacaatgttctttccaacctaaagggggcctagagaatgaaattaatagtggcagtggtgcaggatcaggacagcaacaggcttttgaaagtattaaccgaccacaacttcagggtgacgaagcttgcgacaacaggcggattccttaaatcaggcaatacgacgtttatgatcggggtggaagatatccgtgtcgataaagcgctcagcctcattaaagagaatggctgtaaacgtgatcagatgattgccccggtatccccgatgggcgggaatgcggattcctacgttccatatcccgtcgaagtggaagtcggcggagcgacggtctttgtcctcccggtcgatgaatttcatcaattttaaggatttgacgacgtgaaaataaattctgacttacgtacatttattgagaaaaagcagcagcctgcttataaagcggcagagctttccggaacgtttaaaagttcaatggacagccaaagcagcaagctgaaatttgatcagctgagcaggttcttaacggatatagaaacgttcgggaaaaggctgacgaagtcgagaaacttcaaagacttagcgaagttcaaaggattggtaaaacgttttgtaaaagaggccgtagacagcggattatcgcatgagacggagaaaagctttgacttgtacggcagcagccggaccctggggcttgtgaaagaaatagatgaaaaactgcttcagctgacggaagaaatgttagatcaggaaaaaccggcaattgatttgctggatcgaatcggagaaataaaaggtttattgattaacctttacacatagagagtgatacaatggcaatatcatggaaggaaatgaccgggcagcagcccagagtgatgcggcttttgcataacagcattgaaaagaaaaggctttctcacgcatatctgtttgaaggcaaaaaaggtacgggcaaattggatgccgcactgcttctcgcaaaaagctttttttgccttgaagacgggactgagccttgcggagagtgccggaactgtaagcgtatcgaatccggaaaccatcccgacctgcatgtggttcagcccgacggattatccattaaaaaggctcagatccaatcgcttcaggaagagttttccaaaacggggctggaatcgcataaaaagctgtacattatatcccatgcggatcaaatgaccacaaatgcggcaaacagtctgctgaagtttttagaggagccgagtcaagacaccatcgcaattctgattactgagcagctccaccgaatactggataccatcgtttcgagatgtcaggttctcccgttccagccgcttcagccgaaagccatagaagaaagactgattgaacaggaagtgagccctcacatggcccggctcttagcaaatatgacaaataatattgcggaagcagtcgaattaagtcgaaatgatgagtttgcagagtccagagcgaaagtgataaaattgtatgaagtcttacatcagcggaaaggacatgcctttttcttcattcaggatcagtgggtgccctttttcaaagaaaaaacccatcaagaaatgggtcttgatatgctcttattgatataccgtgatgtattatccatccaaattggaaatgaagataaactgatttatcaagacttattccaatcaataaaacagcatgcgctgcaatttacacaacaaagcgttacgaaccaaattctcgctgttttagaagcaaaaaaacggcttcattccaatgtgaatgtgcagggattaatggagcacttggtgttaacgttgcaggagggataagcttgtacaacgtaataggcgtccgctttaaaaaagcggggaaaatttattattttgatccgaatggatttgatatagaacaagacagctgcgtcattgttgaaaccgtaagaggtgtagaatacgggcaggttgtcatcgcaaataaacaagtggacgagcatgatgttgtgcttccgcttcgaaaggttattcgcgttgctgatgaacgcgatcttctcattgtagaagaaaacaaacaggaggccctgtccgcttttgaagtctgtcagaaaaaagtggctgaccacggcttagatatgaagctggttgatgttgaatttacgtttgaccgcaataaagtcattttttactttacggcagacggacgggttgatttcagggaattggtcaaagacttggcttctatctttaaaacgagaatcgaattgcgtcaaatcggggtaagggacgaggcgaaaatgctcggcggtatcggaccatgcgggagaatgctttgctgctccacgttcctcggtgattttgaaccggtgtccatcaaaatggcgaaggatcaaaatttatcgttgaacccaacgaagatttccggtctgtgcggccgtttgatgtgctgtttgaagtatgaaaatgatgagtatgagacggcaaaagaacagctgccggatttaggcgaaatgattacgacggcaaacggccccgcaaaggttgtcggtcttaatattctggaacgggtgcttcaggtggaactgaagaatcgtgaaaaagtgatagaatatacttgggaagagctcttggaagagggcgtcgtatccgcacaaaccacagattaacgaggtgtggaaccttggataaaaaagagttatttgatactgtcataaacctggaggaacaaatcggttcgctgtaccgtcagctgggtgacttaaagcagcatatcggcgaaatgattgaagagaatcaccatcttcagcttgaaaataagcatttgcgtaagcggcttgatgacacgacggagcaaattgagaagttcaaagccgatcagaaagaaacaaaaacacagaaggcagagcagagtgatataggagaagggtacgacaatctggcccggctgtatcaagaaggctttcatatttgcaacgtccattatgggagcgtccgcaagggagattgccttttttgtctgtccttcttaaataaaaaataaggaaaaggcttccgctgatgtcggaagcctttttcaaagagtgccgaaaggaataagattatggtttcattacgtgatgatgaaagattggattacttattagcagaggatatgaaaatagtacagagtccgacggttttcgctttttcattagatgccgtgctgctgtctaagtttgcatacgttccgattcaaaaggggaacattgttgatttatgcacggggaacggcattgtgccgcttttgctcagcacaaggtcaaaagccgatatcaccggagttgaaattcaggaacgcttgtatgatatggcgcttcgaagcgtggaatacaacgggctgggcggtcagatcagtctcattcatgatgatctgaaaaatatgccggaaagactcggacataataaatatgatgttgtcacctgcaatccgccttattttaaaacaccgaaagaggcggagcagaacctgaacgagcatctcagaatcgcaaggcacgaaatcctttgcacgcttgaagatgtgatttccgtcagcagcaaactgctgaagcaaggaggaaaagcggctctcgttcatcggccggggaggcttctggaaatctttgaactaatgaaagcataccgaatagaaccgaaacgggttcagtttatttatccgaaacaaggtaaagaagcgaataccattttggttgaaggaattaaaggcggccgccctgatctcaaaattcttcccccgctctttgtatataatgaacaaaatgaatatacgaaagagatccgcacgattttatatggagacaaatagtcatttcttttatgtgctgctgtgcaatgacaacagtctgtatgccggttatacaaatgatctgcaaaaacggctgaaaacccacaatgagggaaagggcgcgaaatatacaagggcgagaaggccggtttcgttatgccatgcggaatcatttgaaacaaaacgggaagcgatgcaggcggaataccgttttaagcagctgacccgaaagaaaaaagagcaatatatagaagaaaaacgacgcagcaaggaggctgtatatgttaagacgtcagatgagttttaacggaaaatctgaaatgggaactctgtaccttgttcctacaccgatcggcaatttggaggacatgacctttcgtgcagtagagacgctgaaatcggccgatgtcatagctgccgaagatacgagacagacgaaaaagctgtgccatgtttatgacatagaaacatctctcatcagctatcatgaacataataaagaaagcagcggccataaaatcattgaatggctgaaaagcggaaagaatgtggcattggtcagtgatgccggtatgccgacaatttccgacccgggggctgagattgtgagagatttcacccaaatcggcggatatgtcgttccgcttccgggtgcaaatgcggcattaaccgcgctgactgcatcagggatcaccccgcagccgtttttcttctacggattcttaaacagacaaaaaaaagaaaagaagaaagaactcgaaatcctgaaaaaacggcaggaaacgatgatattttacgaagcgccgcacagattaaaagaaacattaacagcaatgcatgacgttttgggtaatcgaaccatcgccgtcacgagggaattaacgaaaaagtatgaggaattcatcagaggaaccatcgccgaggtgcttgaatgggcaaatgaagatcaaatccgcggtgagttttgtctcgttgtcgaaggcaatcaaggcgctgaaccggatgaagaggaaaagccttggtgggcggagctttctgagaaagaacatgtggagcattacataaatgaaggatcttcttccaaacaggccataaaacaaacagcggtagatcgggacgtaccgaaacgcgagatttatgacgcttatcacattcaatcataaaaaaaaccgttcttgtgtcataacaagaacggtttttgtatgaaatagcttatttttggttttgaagctggttttgaatttcagagatgatttgctcagcgccttctttgctgagtaccaatttgccgccggcaagtttaaggttatcatcagaaacttcaccagttacttggcaagtcatgtttggtttatattttttaaggatgattttttcatcatcaacataaatttcaagagcgtctttttctgcgatgcccagtgtacggcgaagttcgatagggataacgacgcgtccaagttcatcaactttacgtacgataccagtagatttcattaacagtctcctcccgagagataattatttgtagtttatatttttcttcgtcattattcgacaaaattccttacattcctagcataacaaggtttccaataatcgtcaatctttttgtttgctattgtttgtaagaattagttcttatagtaagtaaagccttggaaatcctgaaataacaggctttttgactgctttttcgaacctattatcctactgaaaatccttttaaatcaagactttcgaaccaagatgttttatattagtagattatatacgacaaatttcgacatgttaagactttttttaatttcaataaaaatttttaattttatttactcttttacgcgcagtacgtatatatccttgatcttaaaggctaagatggtatcatagatagaggacaaatatcaatattgtatatcaaataaaaccgctctcgtcctttgggcgtgagcttttcgacattctgaatgggaggttgcaacatgccgcaagacaataatactttttatattacgaccccgatatattatccgagcggaaaattacatatcggccatgcttatactaccgtggcaggcgatgcgatggcgcgttacaaaagattaaaaggatttgacgtacgctacttaaccggaacggatgagcacggacagaaaatccagcagaaagcggaggaagagaatatcacgcctcaagcttatgtggatcgcgcagttgctgaaatccaaaagctatggaagcagctcgacatttctcacgatgatttcatccggacgacggaaagccggcacaaagaaattatcgagaaagtgtttcaaaaacttcttgataatggtgacatttacctggatgagtatgagggctggtacagcatccctgatgaaacattctatacggaaacacagctggtggatgtggaacgaaatgagaagggtgaggttgtcggcggaaaaagccctgacagcggccacccggtcgaattaatcaaagaggagtcatacttcttccgcatgagcaaatatgcagaccgcctgctgaagttttatgaggaaaatccttctttcatccagcctgaatcacgcaaaaatgaaatgattaacaacttcattaaaccggggcttgaagatttggccgtttccagaacgacgttcgactggggcgtaaaagtgccgggaaatccgaagcatgtcgtgtatgtatggattgacgcactgttcaactatattacagcgctcggttacgatacggaaaatgatgagctttacaaaaagtactggccggctgacgtccaccttgtcggtaaagaaattgtccgttttcataccatttactggccgattatgctgatggcgcttgatctcccgctgcctaagcaagtattcgcgcatggctggttattgatgaaagacggaaaaatgtcgaaatcaaaaggaaatgtcgttgatccggtaacgttaattgaacgctacggcttggatgaacttcgctattacctgcttcgcgaagtaccgttcggttcagacggtgtctttacgccggaaggtttcgtagaacggattaattatgacttggcgaacgacttaggaaaccttctgaatcgtacagtcgcaatgatccaaaaatattttgacggcgagattggttcatatgaaggaaatgtgaccgattttgattcagagctttcttccgtagccggtgaaacggttaaagcttatgaaaaggcaatggaaaacatggagttttcagtagctttatcaacgctatggcaattaatcagccgtacgaacaaatatattgatgaaactgctccgtgggtgcttgctaaagatcaggaaaaagaaaaagaattacgttctgtcatgtatcatttagctgaatcattgcgtatttcggccgtattgctacagcctttcttgacgcagacgcctgaaaaaatgttttcccagctcggagttgaggatcagtctcttaaagcttgggacagcattcagacattcggccaattgaagaatgtgaaagtgaaaaaaggggaaccgcttttccctcgtcttgaagctgaagaagaagtagcttacatcaagcaaaaaatgcaaggaactgctcctgctaaagaagaaaaggcggaagagccgcaagaagcagagcgtcttcctgaaattacgtttgatcaatttatggatacagaacttcgcgtcgcagaagtcttgtccgcggaaccggtgaaaaaagcagatcggctgctgaaattgcaaattgatctgggctttgaacagcgccaagttgtatcaggtatcgcgaagcattacacaccggatcagcttgtgggaatgaagatcatctgtgtaacgaatttaaaaccggtaaaactgagaggcgagctttctcaaggaatgatactggcgggagaatcggacggcgttctcaaagttgtagctgtcgaccagtcattaccgaaaggcactcgaattaaataataggggcaaaaggtgtttcacgtgtaacattccgtcgaacaccttttgtttttcaacaagaaaggagtttttatgatgctttttgatacacatgcgcacttaaatgccgagcaatttgacacagacttagaggaagtcattgcgcgtgcaaaggctgaaaaagttgaacgaattgtcgttgtcggattcgacaaacccactatcacgcgtgcgatggagctgattgaggaatatgactttatatacgctgcgatcggctggcatccggtagacgcaattgacatgacagaggaagatttatcatggattaaggaactgtcctctcacgaaaaagtcgtggcgatcggagagatgggccttgattaccactgggataaatcaccaaaagacattcagaaagaagtattccggaaacaaatcgctctcgccaaagaagtgaaccttccaattatcattcataatcgtgatgcaacggaagatgttgtcacaattttgaaagaagagggagcggaagaagtcggcggcattatgcactgctttacggggagcacggaggttgcacggcagtgtatggatatgaatttctatatttcattcggcggaccggttaccttcaaaaatgcgaagaaaccaaaagaagtagcaaaggaaattccgaatgaccgtttgctgattgaaacggactgtcctttcctgacaccgcatcctttccgcggcaaacgaaatgagccaagctacgtaaaatatgttgctgaacagctcgctgaattaaaagggctgacatatgaagaaattgcctcaattacaaccgaaaacgcaaaaagacttttccgcatgaactgacagaatgcgctgtcataacgtgtaaaagcttgtccgattcagtggatatgtaaaacggttctacaagcttccttctcctcataagataggttgtcgatatgtctctcttcctttttttgctttgtttttgcataatgagggatacgctgaaggtttttcatcttcgagatgggagggttgacagcattttagatactctatataatctctccgaggagaaggaggcgtttttcatcacacaaaaaatgaaaaaactgttttccgtaaagcttggtaaaagcaaggttattctgattgcagctattattctgctgggcggaaccgggactgcatacggggcacatgagctctcaaaacaatcagtttctgtttccatcaacggcaagaaaaagcaaatacgcactcatgcaaaaacggttggggaacttctggaagatttacatatagagacgagaaatgaagaccggattaccccgtctaagcagacagcattggcagacaacatgaatgtcgtgtatgatgctgcaaagcagatccgtgtgacaagaggcggagaagaaaagactttatggtcaacggcaaaaacagtcggcgcatttctgaacgaacagcatacacctgtgaatcagcacgataaaatagatccagcagcagatacgaaagtgacaaacggcatgaaagtcacggtcgacccggcttttcaggtcactgtaaatgatgcgggaaagaaaaagaaaatatggacgacttcgactacggtcgctgactttttaacgcagcataagatggacatgaaagacgaagataaagtaaaaccggcattacacgaaaagctcacaaaaaatcaggccggcatacaaatcactcgtatcgaaaaagtcaccgatgtagttgaggaaaaaatagcgtatcaagtgaaagaaaaagaagatgcgtctctcgacagcgggaaagaaaagatcgttcaaaaaggaaaagaaggcaaacttaaaaagcattttcatgttgtcaaagaaaatggaaaagaagtatcaagaaagcttgtcaaagaagaaacatctgaaaaaagcaaagatcagatcattgcggtcggcacaaagcggcacagtcccaagattgagcagctcagtgcacctgtgaaggcatcttcgggcgaaaccggatcttccggtaaagtgattaccgtgtcttccacggcttataccgcaagctgcagcggctgttccggccaaacggctacaggcgttaacctgacaagcaatccgaatgccaaagtcattgcggtagacccaagcgtcatcccgctcggcacaagagtccacgtagacggatacggggatgccgtagccgctgatacaggctcagccattaaaggaagacggattgatgtctttttccctgaaaaatcttcagcttaccgctggggaaagaaacaggtcaaaataaaaatcttaaattaattccgattcattcagagggttttgcgccctctgtttttttcgttataataggtaaagtgtattttcagtatattagacgtgacatgcaagcaaaggtttcgttttggatataaaaagtttttttggaggaagtaatgaaaattaaagaaattatagtagtcgagggacgcgatgacactgcgcgcataaaacttgccgttgatgcggatacgatcgagacaaacggttccgcaatcggagacgaagtcatcaggcagattcggctggcgcaggaaacgagaggggtcatcgtgctgacggacccggattttccgggggagaagatccggaaaaccatttctgaagcagtacccggctgtaaacacgcatttctgcccaaacatcttgccaaaccgaaaaacaagcgcggcattggcgttgagcacgcatccattgaaagcatcagagcatgtctggaaaatgtgcatgaagagatggaggcaaagccgagtgaaatttcagctgaagatgtcatacaggccggtctgatcggcggaccggctgccaaaagacggcgcgaacgattgggcgacctgctgaagatcggctatacaaacggcaagcagcttcaaaaacggctgcaaatgtttcaaatcaaaagaagtgattttattgatgcgctcgatgctatgaggcaggaggaacaggatgaacaataaagatatcgcgacacctatcagaacgaaggaaattctgaaaaagtacggtttctcttttaaaaagagtctgggacagaatttcttaattgatacaaatatattggacagaattgtggaccatgcggaaattacggatcggaccggagtcattgaaatcgggcccggaatcggcgcgttgacagagcagcttgccaaacgggcgaaaaaggtcgtcgcgtttgaaattgatcagcgtctgctgcccattctcaatgatacgctgtctccgtatgacaatgtaacgatcattcatcaagatgtgctgaaagcagacgtcaaatccgtcattgaagagcagtttcaggattgtgatgaaattatggtgacggcgaatctcccatattatgtgacgacgccgatcatcatgaagcttttggaagaacatcttccgttaaaaggaattgtcgtaatgctgcaaaaagaggtcgctgagcggatggccgctgatccttcctctaaggagtacggatcgctttccattgcggttcagttctatacggaggccaaaaccgtcatgaccgtaccgaaaacggtgtttgtgcctcagcctaatgtcgattccgccgtcatccgtctcttgcttcgtgacggcccggcggttgacgtcgataatgaaccgtttttcttccagctgattaaagcaagcttcgcacagcgccggaaaaccttgctgaacaaccttgtgaacaatcttccgggcggaaaagagaaaaaagctcaaattgaagaagttcttcaagaaacgaatattgatggaaagcgacgcggtgaatccctgtccatagaagaattcgcgctcttgtccaacggattgcataaagcccttttctaagagggctttttgttttgcgtcaccacttggactgccgctacataggctagaggagaaccttattcattcaactgcaagaaaagcttgaaacatcaagcgccgcagcggaaagaggtgcatttgccaagacttctttcatgatgaggcttagtctatttgtggagtgggtaacgtgcaatttcaaataggagatatggtagccaggaaatcctatcaaatggatgttttatttcgcattatcggtatagagcaaacaagcaacggaaattcaattgccatcctgcatggtgacgaagtcagattgattgcggatgctgatttttctgatttggagcctgtcagaaaagacgaacaggccatgagaaagaaaagagatgaaagcaggatgaatgaatctctcgagctgctccgccaggattataagctgcttcgggaaaaacaggagtattacgcgacaaatcaatatcagcatcaggagcactactttcatatgcccggaaaggtattgcatctggacggcgatgaggcctatttgaaaaagtgcctgaacttttatgaaaaaatcggtgtgccggtatacggaattcattgccatgagaaaaaaatgccggcgtcaattgacgagctgcttgataaatacaggccggatattttagtcatcaccggccatgatgcatattccaagcataagggaggcgtgaacgatttaagcgcctacaggcattccaaacactttgtcgaaaccgttcagagagcgaggcgtaaagtccctcatttggatcagctggtcatattcgcgggggcgtgccaatctcattttgagtctttaatcagagcgggcgcgaatttcgcaagttcgccgtcacgcgtcaatattcatgcgcttgacccggtatatattgtcgcgaaaatcagcttcactccgtttatggagcggatcaatgtatgggatgtcctgagaaatacgctgacgagagagaaagggctgggaggaattgaaacgaagggtgtgctgcgtgtcggtatgccgtataaatcaaatggatgagtgataaaacccgcatatatttcgctatgcgggttaattattttacatattgatacataaatttccggaacttgtgaaaaataacgcagaaatcaatagaattttgtcaaaataattttgttgacaatgacttattaacgttgatataatttaaattttatttgacaaaattgggctcttgttgtacaataaatgtagtgaggtggatgcaatggcgaagacgttgtccgatataaaaagatcgcttgatgggaatttaggtaaacggcttacgttaaaagcaaacggcggccgccgaaaaacgattgagcgttcgggcattttagctgagacgtacccttctgtttttgtgatacaactagatcaagacgagaattcgtttgaaagagtttcatacagttatgctgatattctgactgagactgttgaattgacattcaatgacgatgcggcaagctcagtagcattttaatgggcagtgaaccttttgtttactgctttttgttttgccttctaaagctcttctaattattccctcgaaagtttcagccgattaaacggaagctataggtgtcacatgttttatcgtggcgtgcacgaatggtgatcaattctataaaaggggttgtttcgtttgggcagacgtcgtggagttatgtcagatgagttcaaatatgagctggcgaaggaccttggtttttacgatacggtgaaaaacgagggctggggaggcattcgggcgcgtgacgccgggaatatggtaaagcgcgcgatcgagattgccgaacagcagatggcggctcagaaccaaaataaccgataatgcagtggcccgggggacaatccgttccccggttttttctatcggctgtcaaaaccggcgtcaatttcggataagtacctccgggtctccaaatgtgatacaatgttcatacttatgtttagatggagaagtaggtgaaagctatgcgtattttagaaaaagcgccggccaaaatcaatctgtccctcgatgtgacgagtaaacgcccggatggttatcacgaagtggagatgatcatgacgacaattgatttggcagatcggattgaactgacagaactgcccgaaaacgttatcagagtggcgtcgcataatcgctttgttccggatgatcaaaggaatctggcttatcaggcagccaaactgcttaaagaacggtttcaagttaaaaaaggcgtttcgattatgattacaaaggtgatccctgtagcggcagggcttgccggcggaagcagcgatgcggcagctacgctcagagggctgaacaggctttgggatttaaagctttctgtcgaagagcttgcagagcttggagctgaaatcggttcagacgtgtccttctgtgtatacggaggcactgccctggcaaccggacgcggtgagaagatcaggcacatcagtgctccgcctcattgctgggtcatgctcgccaaaccgacgatcggggtatcgactgccgaagtgtaccgccggctgaacttacagcaggttcggcatcctgatgtgcaggcgatgattgacgcgattgaagaaaaaagcttccaaaaggtatgcggacaattaggaaacgtattggagtcggttacgctcagcctccatcccgaggtggcgatgattaaaaatcaaatgaaacgcttcggcgctgatgcggtgttaatgagcggaagcggaccgactgtattcggtttggttcaatacgaatcaaaggtgcagcggatttataacgggttaagaggtttctgtgatcaagtgtacgcggtgcggatgatcggcgaacagaatgctcttgattaaatccgtatgttaagttatattatttttaaattattcggattttgggggtaagttcatgaagtttcgtcgcagcggcagattggtggacttaacaaattatttgttaacccatccgcatgaattaataccgttaacgtttttctcagaacggtatcaatcagcaaagtcatcaatcagtgaagatttaacgattattaaacagacctttgaacagcaaggcattgggacgctgcttacagtgccgggagctgccggaggcgtcaaatacattccgaaagtgaaacaggctgaagcagaagcgtttatacaggagctgggacagtctttagtaaatcctgagcgtatccttccgggcggttatgtatatttaacggatatcttaggaaaaccatctgtcctctctcatgtaggcaggctttttgcttccgtttttgcggagcgggagattgatgtggtgatgaccgttgcgacaaaaggaatccctcttgcttacgcagcggccagttatctgaacgttccggttgtcatcgtacgaaaggacaataaagtgactgaaggctccacggtgagcatcaattatgtatcaggatcgtctaaccgcattcaaacaatgtcgcttgcgaaaagaagtttggctacgggttcgaacgttttgattattgacgactttatgaaagccggcggcaccattaacggcatgatcagcctgcttgatgagtttaatgcaaacgtcgcggggataggcgtcttggttgaagccgagggagtgaatgaacggcttgtcgatgaatacatgtcactgctcacgctttcaaccatcaatatgaaagacaaaacgattgagattcaaaacggcaattttctgcgattttttaaagaacagcatttaaagaatggggagacagaaaaatgactaaagcaatccatacgaaacacgcgccggcagcgatcgggccatattcacagggaatcatcgtaaacaacatgttttacagctcaggccagattcctcttactgctgaaggagaaatggtaaacggtgatatcacagaacaaacgcatcaggtgttcagcaatttaaaagctgtgctgaaagaagcgggcgcttctctcgagacggttgtcaaagcaacggtatttattgctgatatggagcagtttgcggaagtgaatgaagtgtacggacaatactttgatgtacataagccggcaaggtcttgtgtggaagtggcgagactgccgaaagacgctctcgtggaaattgaagtcattgcgctggtaaaatcttaaatctcagaaaagtggttccggtctccgggatcactttttttatgcagtatatgatccccaaatatggtttatcacctaattgtgtatgtatatcctatattttcaaaaaaactttttgaaacgtgcaggaatttaaaaagaatcgtggaattgttagactaatgcttttatatagggaaaaggtggtgaactactgtggaagttactgacgtaagattacgccgcgtgaataccgatggtcgcatgagagcgattgcatccatcacgctggatcacgaatttgtcgtacatgatattcgtgtgattgatggaaacaatggtcttttcgttgcgatgccgagtaaacgcacccctgatggagaattccgcgatattgctcatcctattaattccagcacgcggggcaagatccaggatgctgttttaaatgagtatcatcgtttgggtgattctgaagcattagaatatgaagaagccggggcttcttaaacataacaaaatgtaaggactgctgataaaggctgacacaaggccttttccggcagtccttttttaaatctgatttttcagtaataaagcgattacatagaaaattcttgcactttttgatgtcttcttgaaatcaacagctatttaggatatatttttctatggataaaagggatattggaggccattaaatggataagcggtttgcagtgattttagctgccggaaaaggaacgagaatgaaatcgaagctttataaggtccttcatccggtatgcggaaagcctatggtagagcacgtcgcagacgaagctctgaaattatctttagcgaagcttgtcaccatcgtaggacacggcgccgaagatgtgaagaagcagctcggacagaaaagcgattacgctctccaagcagaacagctcggtacggctcatgcggtcaagcaggcaaaaccatttcttcacggagaaaagggtgtcacgatcgttatttgcggcgatacaccgcttctgacggcggagacgatggaagccatgctgaatgaacatacagacaaaggtgcaaaagccacggtgttaacggccgttgccgacgatcccgccggatacggaagaatcatccgcagtgaagacggcgccgttcaaaaaatcgtggagcacaaggatgcttcggagcaagaacgtcttgtgaaagaaatcaacacgggaacgtactgttttgataacgaggctctttttcgtgtcatcgaacaggtttcgaatgaaaatgcccaaggcgagtattatctgccggatgtgatcgaaatcctcaaagacgaaggcgaaactgttgccgcttaccagactggtaacttccaagagacgctcggagtgaatgatagagtcgctctttctcaggctgaaatgtatatgaaagagcgtattaacaaacggcatatgcagaacggagtcactttaatcgatccgatgaatacgtacatctcacctgacgcgcgtatcggacaagatacagttatttatcccggaactgtgttaaagggacaagctgaaatcggcgatgaatgtgtcatcggccctcacactgagatagaggacagttcaatcggcagccgcactgtgattaaacaatccgttgtcaaccgcagcaaagttgggaatgatgtaaatatcggtccttttgctcacatcagacccgattccgcaatcggcaatgaagtgaagatcggaaactttgttgaaatcaagaaaacacaattcggcgaccgaagcaaagcatctcatttaagctatatcggtgatgccgaagtgggcacggatgtgaatctgggctgcggctccatcacggtcaattatgatgggaagaaaaaatatttaaccaagattgaagacggcgcttttataggctgcaactccaatctggtcgctcctgtcacagtgggagaaggcgcgtatgtcgctgcgggttcaaccgtaactgaagatgtgccgggcgaagcgcttgccattgccagagcaagacaagtaaataaagaagattatgtgaaaaatattcataaaaaataatcctaaaatcggaggtttaccatgtctaacgaatacggagataagaatttaaagattttttctttgaattcaaatccagaacttgcaaaagaaatcgcggataatgtaggggttcaattaggaaagtgctctgttacaagattcagtgacggagaggtccagatcaacatagaagaaagtattcgcggctgtgattgctatatcattcagtctacaagtgcgccggttaatgagcacattatggaattgctgattatggttgacgctctaaagcgcgcttccgcgaaaacaatcaacattgtgattccgtactacggttatgcgcgccaggacagaaaagcaagatcacgtgaaccgattacggcaaaactttttgcaaacctgcttgaaacagcgggtgcgacacgcgtgattgcgcttgatttacacgcgccgcaaattcaaggtttctttgatattccgattgaccacttaatgggtgttccgattttaggccattactttgaaggtaaagacttgaaagatatcgttattgtttctcctgaccacggcggtgtgacgcgcgcccgcaaacttgcggaccgtctgaaagcgccgatcgcgattatcgacaaacgccgtcctagaccgaatgaggtagaagtgatgaacatcgtcggtaacgtggaaggaaaaacagcgattctgatcgatgatattattgatacggccggcacaatcacacttgccgctaacgcgctggttgaaaacggagctgcagaagtgtatgcatgctgtacgcaccctgtattgtcaggccctgccgttgagcggatcaataactctaaaatcaaggagcttgtcgtaacgaacagcattaagcttcctgatgagaaaaaaatcgaccgctttaagcagctttctgtcggaccgcttctggctgaagcgattatccgcgttcacgagaaacaatctgtcagctatttattcagctaaaccgaaactttaaggtttaaatcccagttattgtgggtattgttctaataggacgataaaacgataattaggatggtgctgaatatggcaactttaaaagcaaatgaaagaacagattttaaacgttcgacgcttcggaaaatccgtcattcaggacatgttccagggattatatacggtaaagaaataacgaatacgcctgtctctttagacagtgtcgaattgcttaaaacattgcgggacgaaggaaaaaacacgattatcacaattgatgtcaacggaaatcagcaatcggttatggtgactgatcttcagacagacccgctcaaaaacgaattgacgcacgccgattttcaagtcgtgaatatgagtgaggagctcgaggccgaggtgccgattcagctgacgggagaggcgaaaggagtcaaagacggaggcgttatccagcagccgctgcatgagctttcgatcaaggctaagccgaaggacatccctcagacaattaatgttgatatttccgggcttgaaatgaatgatgtgctgaccatcgcagatctgactgctgacggcaattatacatttacaaacgacccggaagaagtcgtggcttccatccttcctcctaagcaggaagcattcgaagaagatgcagaaccgtctcctgaggaagagcccgaaggagaaaatcaataagcgctttaagacgtaacccgcccgaggttacgtcttttgtgctagaatgagaagaattacagcgatgttgagggaggatttacgatgcttgtgattgccggtctcggtaacccgggaaaaacctatgagaacacgaggcataatgtcggctttatggccattgacgagctttctaaagaatggaatattgaactgaataaaacgaaattcaacggactttacggaatggggtttgtttccggaaaaaaagttctacttgttaaaccgcttacatatatgaatttatcaggagaatgtttgcggccgctgctggattattatgatgccgatcatgaagatctgaaagtcatatacgatgaccttgatcttccgacgggaaaaatcaggcttcggacgaaggggagcgcagggggacataacggaattaaatcgcttatacagcacctcggaacccctgaatttgaccgggtcagaatcggaatcggccgccccgttaacggaatgaaagtcgttgactatgtactgggagcttttacgaaggaagaagcgccgcatatcaatgatgccgtctcaaaaaccgtaaaagcctgcgaagcttccttaacgaaaccatttttagaagtcatgaacgaatttaatgcaaatgtataagataaataatgggagaccatactagggaaaaatgattttttcacatcaggaggtccaacgtatggctttgcattatttctgccgccactgcggctttaaggtagggagcctggaatattcaacggtgccgacacagtcacttggatttcagcacttaacaaatgaggaaagaaacgatatgatttcatataaagacaatggagatgtccatgttcttacaatttgtgaagactgccaagaggcgctggaacgcaatccgcactaccatgaacacaacacatttattcaataagaagctttggtgtagattctagaccaaagcgtttttctgttcttgcagaaaatagagaggagggcccatatggacaacattcaaacctttattaaagaaagcgatgattttaaatccattgtcaacggtttacatgaggggctgaaggaacagctgcttgcgggtctgtcaggttccgcgcgttctgtttttacctccgcccttgcacaggaaacgaaaaggccgattttctttatcacccataatttatatcaggcccaaaaagtgacggaagatctgacggcgcttctcggggatcaatctgtttttttataccccgtgaatgaattgatttcttcagaaattgcggtagcgagtcctgaactgcgcgctcagcggcttgatgtcattaatagattaacaaacggagaagcgccggtcgttgtggcgcccgttgcggcagtgagaagaatgcttccgccgaaggagctgtggaaaagcagccagctcgtcatttcactcggagacgatatagaaccggatcagctgtccgcgcgccttgtagaggtggggtatgagcgttccgatatggtttctgcacccggtgaattcagtattcgcggcggaattatcgacatttatccgctgacgtcggagcatccggtgcgaattgaactgtttgatacggaggtcgattccatcagaagcttcaattctgatgaccagagatcaatcgagacgctcaaacatgtggcgatcggaccggcgaaggaattgatcatcagggcggaagaaaaagcccgggcaatggaaaggctcgataaagggcttgccgacagtctgaaaaagctgaagcaggacaaacaaaaggaaatgcttcatatcaatatctcacatgataaagaacggttatcaacgggacagactgatcaggaacttgtgaagtatctctcgtacttttacgaaaaacctgctagtttgctagattatacaccggcagacacgttgttattgttagacgaggtcagccgcattcatgaaatggaggatcagctgcaaaaagaagaggccgaatttacgacaagtctgctcgaggaagggaaaattctgcatgacattcatttatccttcagctttcaggagcttatgagcgaaaagcggcgcccggctatttattattcattatttttgcgtcatgtccagcatacaagccctcagaatatcgtgaatgtgacaagccggcagatgcagagttttcacgggcagatgaatgtcctctcaggtgaaatggagcgctttaagaaatcaaacttcaccgtcgtctttttaggcgcaaataaggacagaaccgacagattggcatccgtgctggctgattacgaaattgaagccgcgaaaacggacagctccaaagcgcttgtgcaaggacaggtctatgtcatggaaggcgagctgcaatccggttttgaactgccgctgatgaagctggccgtcattacggaggaagagctgttcaaaaaccgaatcaagaaaaagccgagaaagcagaagctgacaaatgccgaacggatcaaaagctattccgagcttcaggtcggtgactatgtcgtccacgtcaaccacgggatcggtaagtacttggggatcgaaacactggaaatcaaaggcattcataaagattacctcaacattcattatcagggcagcgataagctgtatgtccctgtagaacaaatcgatcaggtgcagaagtatgtcggctctgaaggaaaagaaccgaagctttataaactgggcggcagtgaatggaaacgggtgaagaaaaaagttgaaaactccgttcaggatattgccgatgatctgattaagctttatgcggaacgggaagcaagcaaaggctatgcgttctcgcccgatcatgaaatgcagcggcagttcgaatctgctttcccttaccaggaaacagaggaccagctccgttccattcaggagattaaaaaggatatggaaagagaacgcccgatggaccgtttgctttgcggcgatgtgggttacgggaagacggaggtagccatccgagcggcctttaaagcgatcgcagacggaaagcaggtcgcgcttcttgtgccgacgacaatactcgcgcagcagcattatgaaaccattacggagcgttttcaggactatccgattaacatcggtcttctcagccgattcagaacgagaaaagaatccaatgaaacgattaaaggactgaaaaacggaacggtagacatcgtaatcggaacccacaggctcttatctaaagacgtcgtctataaagatctcggcttgctcatcattgatgaagagcagcgcttcggcgtaacgcataaggaaaaaatcaaacagatcaaagccaatgtcgatgtactgactcttacagcgacgccgattccgcgtacgcttcatatgtccatgctcggtgtgcgggatttatccgttattgaaacgccgccggaaaaccgtttccctgttcagacatatgtcgtggaatacaacggcgcgcttgtacgagaagctatcgaaagagaactggcgcgcggaggacaggtatatttcctgtacaaccgcgtggatgacatcgagcggaaggctgatgaaatttccatgcttgttcccgatgcaaaagtggcatatgcccacggaaaaatgaccgaaaatgaattggaaagcgtcatgctcaattttctggaaggggaatcagacgtccttgtcagcacgactattattgagacaggcgtagatataccaaatgtcaataccttgattgtgttcgacggagacaaaatggggctgtctcagctgtatcagctgagaggacgggtcggccgttccaaccgcgtcgcttacgcttattttacgtaccgcagagacaaagtgcttactgaggtggcggaaaaacggctgcaggcgattaaagaatttaccgagctgggatcaggctttaaaatcgccatgcgtgacttgacgatcaggggagcggggaaccttctcggcgcccagcagcacggctttatcgactcagtcggttttgacctgtactcgcaaatgctcaaggaagcgattgaagagcggaaaggcgatattccgaaaagcgaacagtttgagacagaaatcgatatcgagcttgacgcgtatattcctgaaaactatatacaagacggcaagcaaaaaatcgacatgtataaacgcttcagatcaatcgccacaattgaggagaaaaatgagctccaagatgaaatcatcgacaggttcggcagctatcctaaagaagttgaatggctgtttacggttgctgagatgaaggtatacggaaaatatgaacgcgtcgaactcatcaagcaggataaagacgcgatcagatttaccatttctgaagaggccagcgcacagattgacggccagaaattattcgaactcggcaataaatacggccggcagatcggactgggaatggaagggaaaaagctgaaaatctcagtacagacgaaaggccgcaaaacggaagagtggctggagaccgtgctcggcatgctgaaaggccttcagaatgtgaagaaagaaacaatcgcgtcttcataaaaattgttactctctggtgtatattacatttgatgtgacggatactaatttcaagcgagtggcggaagctacataaagtaaagagctttagtactttcccttaaatatcatcacatgaaagagaggcaccagagagatgaaagctacaggtatcgtacgtcgtattgatgatctaggacgggtcgtcattcctaaagaaattcggagaacactgcgaatcagggaaggagacccgcttgaaatattcgttgaccgcgacggagaagttatattgaaaaaatattctcctatcagtgagcttggcgattttgcgaaagaatatgcagatgcattgtatgacagtctcggccattccgtcttgatttgcgaccgtgacgcgtatattgccgtttcgggcagttcgaaaaaagaatttctgaataaagccatcagcgatttgctcgaaaaaacgatggatcagcgcagctcagtggtagaaaacgacgtgaagtccgcgcagcttgtgaatgacattgatgaagatatgagctcctatacaatcgctccgatcgtggcaaatggcgatcctatcggtgccgtggtcatcttttccaaggaacaggcgcttggagaagtagaacataaagcggtagaaacggcagccagttttttggcgagacaaatggagcagtaggtcttattaccattattgaaataagaaaacggggaaagaacagctcttatacaagtgctgttctttttcatattcatatgtgctctctatcggttcggccgttaggattgtgatataataagctcgttttatagacgtaattttctagcggctggaaggagcttttggatgaacgattcagttggcgccaagcggcaatcggcatggaaaggtgcttttgtgctcgtcgttgcgggcatcgtgacgaagatattaagcgccgtgtacagggttccttttcagaatattgtcggtgacgtcggattttacatttatcagcaggtgtatccgtttttagggatcgcggtcatgctgtcaacatccggttttccggtgatcatctcaaaattaatgaacgattatagcgatcataaacaaaaaataatgaaaatttccgccctttatgtcacggcggccggacttgttctgtttgcgctcatgtatgccggcgcggcgccgttggccggttttatgggtgatgcccgccttgtgatgctgataagggtcgcggcgttcgctttcatactgtttccgtttacggcggttttccgggggtatttccaaggcgtgcatgatatgatgccgtcagccttatcccagattacggaacagcttcttcgggtggcggtgcttctcggtttatccttctggcttttgaaaagcgggcgttcattatacgcggcgggtgcgggggcggcctcgggatcaattgccgggagctttgcggccctttgtgtattggctgttttctggtataagcgggaagaaacaaagaaagacggcggacatatcgaaacggccgtcattgtaaaaaagctgctgctttattcagtcaccatctgtatcagcagtgtactcatgcttttgattcagcttgtagacgccttaaacttatattcactgctttcagacgggacggagagccatgccgcgaaacagctgaaaggcatatatgaccgcggacagccgctccttcagctgggaaccgtgtttgccgtcagtatcgccgcgtccttggttccttcaatttcaaaagcggtgcatgagaacaagccgtttatcataaaagagaaagcgtcatctgccgtcaagctctgccttgcggtagggatcggtgcatcagccgggcttttttgcattttagaaccggtgaatatcatgcttttccaaaacagtgaggggacgccgaccttacaaatattcagcttatctatcttttttgcctcgattgcgcttacggcagccgcaattctgcaaggagcgggacataccgttttccccgccgtatccgttttggcgggaggggcgctgaaatgggtgctgaatgtttggctggtccccggctggggtattacaggagcggcactggcgaccgtcttggcatttgccgcagttgcgtgcctgaatctccggagaatttggtcgaagggatggctgacgaatatcggaggcgtgattgcccgtctgtgctggtgcagtctgctgatggtcttctttttggtcgtatacatgaagctttggcagttatttgttcctgtcagcagggcggagctgtatgtgagagtctgtctgcgtcaatcatcggagggctattgtttatttattgtatgataagaatgaagattttcacggacgaagagctgagcggtcttcctttcggcagtgctttaagcaaattgaaaaagaggagagaaaaacatggcaggtaatattacggtcgtcggcctcggcgccggagacatggatcagttgacagtgggcgtacataagctgctgactcaggcgaagcatttatatataagaacgaaagaccaccctttgatttcggaattagagcaagagacggaagcggacatccggtattttgatgatatttatgaaaaacatgatcagtttgaagcggtctatgaagagatcgcggacattctgtttgaaaaagcgaagcaagaggatgtcgtctacgctgtacccgggcatccgtttgtcgctgagaaaaccgttcagctgttatttgaacgccgggaagaacaacagatagatgttcataccgctggagggcaaagctttctggatgccacttttaatgcgttgcgaattgatccgattgaagggtttcaatttacggatgcgcaaacaatgacgccggatgagctcgaactccggcatcacctgatcatctgccaggtttatgaccaaatgacggcctctgaggtgaagctgacgctcatggagaaattgcctgacgactatgaagtggtcatcgttacagcagccgggagcaagggagaaaagatgatcaaggtgcctttgtttgaacttgaccgcaatgtagaaataaataacttaacaagcgtgtatgttccgccgattaaaaaagaagaactcctttaccaggaattttctgcattccgaagtattattcgcgagcttcgcgggccgaacggctgtccgtgggatcaaaagcagacacaccagtcattaaagaaatatatgattgaggaatgctacgaactgcttgaggccattgacgaagaggacacggatcacatgatagaagaactcggggacgtcatgcttcaggttatgctgcacgcccagatcggagaagacgaggggtatttctcaattgatgatgtcatcagagacatcagtgcgaagatggtcagacggcacccgcatgtgtttaaggatgttaaggttcaggatgaacatgatgtcgtcgccaactgggaagaaatcaaaaaggcggaaaagcaaacaacatcctcttcattgctggatgccgtgccgaaaacactgccttctcttgcgaaagccgccaagcttcagaaaaaagccgcaaaaaccggctttgactgggataacgttcaggacatatgggataaagtaaatgaagagctgaaggaattttctgcagaggcttccgccgaatcagcagatgaaatcagcttaaaagctgaattcggcgatgttttatttgcattggtcaatatcggccgatactataaaattgagcctgaggaagcgctcgccatgacaaatgacaaattccgcagacgctttgcttatattgagaaagaagcggcagcaaagggccttgaattgaccgcaatgtcacttgaggaaatggacaaattgtgggatgaagcaaaagaaatggagaggagattctgatatgagacttgataaatttttaaaagtatccagattaattaagcgacgcacattggcgaaagaggtcgccgatcaagggagaatcaccgttaacgggaatcaggcgaaagccagctcagacgtaaaagccggtgatgaactgaaggtccgcttcgggcagaagcttgtcaccgtgaaggtaaatgaattgaaagaaacaacgaaaaaagaagaagccgcgggcatgtatacaatcgtcaaagaagaaaaactcggcgaataggcttgttctaaacaaggctcccgcctcatacaatgcagtaataatgctaaaagtatcgaggatatgggggctgaatagatgaattcatattatgagcaaaaaggttcttcttctgttccggaacagcatgatgtaacgatgaaagggagaaagcatttagacatttcgggcgtcaagcatgtggaaagttttgataacgaagagtttttgctggaaacggttatgggaatgctttccgtcagaggcgagaatctgcagatgaaaaaccttgatgtggaaaaagggattgtatctataaaaggcagggtgtttgaccttgtatatttagacgagcagcaaggggataaagctaaagggttttttagcaagttgtttaaatgacgctgacgacccaattttatacgatgctggcaatgaccggtatgggcgcctggctcggagcgtcgcttgatacatacaggctgtttgtcagccgcgccaaaacggccagatggctgttattcattcatgacattctcttttggattgtacaaggtctgctgtttttctatgtgctgctcaacgtgaatgaaggggaactcagggtatacattttcttggctgtcttactgggtattgcgacgtaccaaagcctgtttaaacgaatgtatataaaaatactgaaatttgccattcatcttgcggtgtctctttaccaattcgcaaaaaagctcattcagcacgtgctgttccgtccggtgcttctgctctttaagctgctcatcgggctgatcacggttatttctttatactcctatcgggtgagtgccttttttgcgaagtgtctttttaagatcgtagcgtttttgctgtatccgctgtttttcctgttgaaacaattattgaaacttcttcctgaaaagtggcgtcttactttcaaacgatattttcaaaaaagtgcaggatttttacaaaagagcaagaaactaatcataacaatcagatcgaccatgatacgtattttgaaaaggtgaaaggaggaccgtctggtttgaatctatctagggaacgtacaataactgaaattcaaaacgactataaagagcaggttgaacggcaatcccagcttatgaaaagaaggcggaaagggcttttcagacggttgatcgtattcggcgcccttgtgttgttgacggctattgtcttagcgggttctctgtggtcacagacctcttcccttagcgcaaacgaagaaaaaaaggctcagctggaaaaacaagttaaagaattgaatgcgaaacaggctgatttaaaagatgaaatttccaaattaaaggatgaggattacgtcacagagcttgccagaagagacttgtttatgtcaggaaatggtgagattctctttaatgtagaaaagaagagcaagtagccttgttgacacttaaatttttatttaggtataattaaacaaacgatctttttataagcctaaggaggagcactttttttatgtcgattgaagttggcagcaagttgcaagggaaaataacaggtattacaaatttcggagcatttgttgaattgcctggaggctcaaccggtctcgttcatatcagtgaggtagccgataattatgtaaaagacattaacgagcatttaaaagtcggcgatcaagttgaagtgaaagtcatcaacgttgaaaaagacgggaaaattggtttatcaattaaaaaagctaaagaccgtccgcaagccagacctagaaatgatttccgtccgaaagaatcttttgaacagaaaatgaacaagtttcttaaagatagcgaagaccgcttatcatctttaaaacgaaacacggaatcaaaacgtggagggcgcggagcaagaagaggataacttgctgctttctataaatacatggagcatccgtctatcccagcgggtgctttttttgtatacgcgcatgtagtcagaaaattaaaactttaaagtttctgttgacggaatgaagaaacctttgtattatataacttgtgcttataagcacctatatggcggtgtagctcagctggctagagcgtacggttcatacccgtgaggtcgggggttcgatcccctccgccgctaccatatatatctggcccgttggtcaagcggttaagacaccgccctttcacggcggtaacacgggttcgaatcccgtacgggtcatcaagcgaatcggcttctgttgcagaagccgattttttcatatttagacaactttttgagaaatgtcggaggaaatacaaaaggaaaggggaacaagggagaaagcgtcgaagagttctttggaattgttaccttcttttgacaaaatcctatctgggctttcatttataatgacaagcaacgaataaaacaggtgggggatgagagcaatggaaaaagcggaaagaagagtgaacgggccgatggcgggacaagctctggaaaaactgcaatcgttttttgaaaaggcggcaaagcttacagtccatcaagcgcattcactttttttctataagggtttcatttatgtcgtgatcggttttttacttggacgggctttcatattatctgaggttcttccatttgcactgccgtttttcggagcgatgcttttgatcagaagagataaagccttctatgcttgtctgtctttacttgcgggcgctttaaccatttcgccgaaacactctttattgattctcacagctttggccgtcttcactctattttcaaaaatcggtacatatatcgtgcaggaccgggtgaagatgctgccgatcgtggtgtttttctctatggctgccgcgagaatcggatttgtttattttgaaagcggcgcttttaccacctatgattatgtgatggctgttgtcgaggcgggcctggcctttattttgacgctgatctttttacaaagcctgccgattttcacgatcaaaaaagtgaagcaatcgttaaaaatagaagaaatcatctgttttatgatcttgatcgcatccgttttaaccgggcttgccggtgtttcatttcagggaatgcaggctgaacatatcctggcccgctatgtcgtgctgagtttttcctttgtcggcggggcaagcatcggctgtacggtcggtgttgtgaccggactgatcctcgggcttgcgaatatcgggaatctctatcaaatgagtctgcttgcgttttccgggcttcttggcgggctgctgaaagaaggaaagaaagccggcgccgcagtcggattggtgatcggctcactgctgatttcattatatggtgaagggtctgccggattaatgaccactctttatgaatctttgattgccgttgtattgtttttgattacgccccaatcgattacgaaaaaggtggcgcgatacataccgggcactgctgagcacagtcaggagcagcagcagtacgcgaggaaaatcagagatgtcaccgcccagaaagtagaccagttctccaatgtgtttcatgccttgtcggagagcttcgccacctttcatcagacgtcttccgatgagcaggcggaagaaggggaagtggatctctttttaagcaaaatcaccgagcattcctgccaatcctgctataaaaaaagcaaatgctgggttcaaaactttgataaaacatatgacttaatgaaacaagttatgcatgaaacagaagaaaagcagtatgcctcaaaccgcagattgaaaaaagagtttcaacagcactgttccaaatccagacaggtggaagagctgattgaggacgaacttgcccaccatcacgcccatctgacactgaagagaaaagttcaggacagcaggaggcttgttgccgagcagctgttgggggtttctgaggttatggcggacttttctcgggaaataaaacgggagagggagcagcattttattcaggaagaacaaatgatagaggcgcttcagcatttcggaatcgagattcagcatgtcgagatatacagcttggagcagggcaatattgatatcgaaatgacaatcccgttcagcggaggacacggcgagagtgagaaaattatcgccccgatgctgtctgacattcttgaggagcagatacttgtcaaaagcgaacagcactcggctcatccgaatggctacagccatgttgcgttcggttcgaccaaatcgtaccgggtatcgacaggcgcggctcatgcggcaaaaggcggcggccttgtctccggcgacagctacagcatgatggaactgggggcgagaaaatatgcggccgcaatcagtgacggcatgggcaatggggcgagggctcattatgagagcaacgaaacgattaagctgctcgaaaaaattctcgaatcaggtattgatgaaaaaatagcgatcaaaacgatcaacagtattctgtctttacggacgacagacgaaatctactcaactctcgatctttctatcattgatcttcaggatgcaagctgcaaattcttaaaggtcggttcaacgccgagttttatcaagcggggagatcaagtcatgaaagtgcaggccagcaatctgccgatcggtatcatcaatgaatttgatgtggaggttgtaagtgaacagttaaaagcgggagatctgctcgtcatgatgagtgacggtatttttgaaggaccgaagcacgttgaaaaccacgacctgtggatgaaacggaaaatgaaagggctgaaaaccgaagatccgcaggaaatcgctgatatattaatggaagaggtcatcagaacgcgttccggccaaatcgaagacgatatgacggtggttgttgtccggattgatcacaacacgccgaaatgggcttccataccggtgccggcggtattccaaaataaaaaggagatttcttaatcctttcgtataaatcactttccttctggcgaagatgggactaatcgtatcaccgggaggaatgtatgtgaataagggacatttaaatcaagttctgctgattacagatggctgctccaatcatggtgaagacccgattgcaatggcggctttcgccaaggagcaggggattacggtgaatgttatagggattatggaagaaaacgcgattgaccaagaggcaatgaaggaagttgaaggcatcgccatggccggtggcggcgtccatcaagttgtatatgcgtcacaattgtctcagacggttcaaatggtgacgaaaaaagcaatgacccagacgctgcaaggtgtcgtcaatcaagagcttaaacaaatcttagggaaaaacgttgaaatggaagagctttctccggaaaaacgcggcgaagtgatggaagtggttgatgaactcggagaaacagttcatctgcaggtgcttgtgctggttgatacgagtgcgagtatggcgccgaaactgccgacggtgaaagaagcgctgattgatctttccatcagtttaaattcccgggccggacaaaatgaatttgccatgtgtatatttcccgggaaaagccaggaagttgagcttgtgctgaattggacgccgaagcttgaatccctttctgcgctctttgcgaagctgtcgaccggcggtatcacccctacgggccccgctatccgggaagcgacgcagcagtttgagagaatccgctcaagaaggagcatgttggcagatgatgaacgacgctttaacgagtttggcatgtagtctggcaccggggacggcaattcagggcaaatggaacggcaaatcctacagattgctcaaacagcttggaaaaggggctaacggtattgtatatctggcagaagcatcaggcggacaggtcgctttgaaaataagcagcgacagcatgtctgttacctctgaagtgaatgtcttaaaatccttttcaaaggcccggtcgcaaacgatggggccttctttttttgatgcggacgatgcgtttattccgcagctgaataaaaatgtctctttttacgtgatggagtacatagaagggccgcttcttccgcaatatatcagcagtaagggagcggagtggattccggtgctgatggtgcagcttctttccagcttgtcagtccttcatcagcagggatgggtttttggcgacctcaaaccggaaaatcttattgtaaccggaccgccggctgccatccgctgcattgatgtagggggaacgacaaaacaaggccgcgcgattaaagagtatacggagttttacgacaggggctattgggggtatggaacaagaaaagcagaaccatcctatgacctgtttgctgtcgcaatgatcatgatccactgtgtccagaagaaagagtgcaaaaagtcaggacagccgaaagaacagcttcgttctatcattgaaggccacccgtttctgaataagtataagaaggttctgttttctgctttaaacggccaatatccgtctgcggaagccatgaagcatgacatcctgacggcggggcagagcgccgggagtaaaaggaaagccgccgccaagcctaagccgccgcaatcaaaaccgcggcagggcactgtatctcaaacgcggtataaacctaaacaaaaacccgcaaagcacaatggtttgtttgaaacaacgcttattttaatcagcgttctcgccctttatttcgcttacatcgtcttttttctcatctaatgccggccggacgcctgcgctcatgcttcttctttgcttggagggaatgaaagtgataggatatgtatatctttaaaaaaacctgctcattgtgaggggacattgtgaaaagcgtggaagattttttcaaaacatatcatcttcaggcggagggagaaacgattattgccggggtctccggaggccctgattcaatggcgcttctcagtatgctgaataagcacttcgggcattcttccgttatcatagcggcgcatgtcgaccatcagttcaggggtcctgaatctgaagaagatatgaagtttgtgcagtcatattgcgaagcggaacacatcctctgcgaaacggtacagattgatgtttctgcatacgcaaagaagaataagctgaacaagcaggctgccgcgcgtgattgcagatatcagtttttcgaagatctgatgacaaaacaccaagcgaagtttttggcgctggctcatcacggcgatgaccaggttgagacaatgctcatgaggcttgcgaaaggtacgctcggcgcagggctcgcgggaatgcagcccgtccgcgaatttgcatccggctggctgatcaggcctttcctctatgcggaaaaggatgaaatcctagaatactgccgtcaagaagggctcagctacagaacggatgagagcaatgcaaaagacgattatacaagaaacagattcagaaagaccgtgcttccttttttaaaacaagaatcacctgacgttcataaaatgtttcaaaaggtgagtgaagcactgacagaagacgaacaatacttgcagtcattaacgaaagaacgaatgaataaggttattacaagcaagtctgacacatcggttgaagtcgattcctctcaattgcttgcccttccgatacctttacaaagaagaggagttcaactaatattaaactatctttatgaaaacgttccatcgtcgttttccgcccgccacatacagcagtttctggaatgggcggaaaatggaagcgcctcgggagtgcttgattttccgaaagggctgaaggtggtcaaatcatatcagacatgtttgtttacatttgaacaatggcaatgtgaaaaggttccctttgagctgcagctgcaaggagcggaaggcgagactgctgttctccccaacggctttatgatagaggtggccgatcaggctgaccctcatatcaaaaatgggaatgctgtttttatgacaagcagaaataaggtgcaatttcctttaacaatccggacgagaaaaatcggcgaccggattaaacttaaagggatgaatggctcgaaaaaggtaaaagatatatttattgatcataaactgcctctgcgggatcgggacgaatggccgattgtaacggatgcgagcggtgaaattatctggctgcctggcttgaaaaaatccatctttgacgatcttgtgatttcaaacagtgaccgcattgtattacaatatagacagcatgaaaagtgtagggggcaagcattaacatgaaacaggatatcgaaaaagtgctgatctcagaagatgagatccagcagaaagtaaaacagcttggagaacaattaacaagcgagtacagcgacacgtttccgttggcaatcggtgtgttaaagggagcgcttccttttatggctgatcttataaagcatattgatacatatttggaaatggacttcatggatgtatcaagctacggaaattccacggtttcttccggagaagtcaaaatcatcaaagatttggatacatctgtagaaggccgggacatcttaatcattgaagatattatcgacagtgggttaaccttgagctatctcgtagaactcttccgatatcgtaaagcgaaatcaattaagattgttaccctgttggataaaccaagcggaagaaaagcggacattaaagcagacttcgtaggctttgaagttcctgacgcgtttgttgtgggttacggacttgattatgccgagcgctatcgcaatctgccttacatcggagtattaaaaccggcgatttatgaaagctgatcggctgcctgcttccgagatggttatcggttgtattggaatgattttctatggtactattgaacatagttgtgcttactgtgggaggaggtaaggaatgaatcgggtcttccgtaataccattttttatttacttattttattagtagtaatcggggttgtgagttacttccagacctcaaacccgaaaacagaaaatatgtcgtacagtacgtttatcaagaacctcgatgaagggaaagttgatagcgtatcggttcagcctgtcagaggtgtttatgaggtaaaaggacagctgaaaaaatacgacaaagaccagtactttttaacacatgttcctgaaggaaaaggagcagaccagatatttgacgcaattaaaaagacggacgtaaaagttgatcccgcacaggaaacaagcgggtgggtgacgttcttaacgacgatcattccgtttgtcatcatctttattctgtttttcttcctgctcaatcaggctcagggcggcggcagccgtgtcatgaacttcggaaagagcaaagcgaagctgtatacggaagaaaagaaacgcgtgaagtttaaagatgtagccggcgcggatgaggagaagcaggagctcgttgaggttgttgagtttctgaaagatccccgcaaattcgccgagcttggcgccaggatccctaaaggcgtgctgcttgtcggacctccgggaaccggtaagacattgcttgcgagagcctcagccggtgaagctggcgttcctttcttcagcatcagcggatctgacttcgttgaaatgtttgtcggtgtcggtgcttcccgtgtgcgtgatttattcgaaaatgcgaaaaagaatgcgccttgcctgatcttcattgatgagatcgacgcggtaggacgtcagcgcggcgccggtcttggcggcgggcatgatgaacgcgaacagacgctgaaccagctgcttgttgagatggacggtttcagtgcgaatgaaggaatcattattatcgctgcgacaaaccgtgcggacattcttgaccctgcattgctccgtccgggacgttttgaccgtcagattacggtagaccgtccggatgtcatcggccgtgaagccgtattgcaggtgcatgcgagaaacaaaccgcttgatgagacggtgaacttaaaagcaatcgcttcaagaacacccggtttctcaggcgcagatttagaaaaccttcttaacgaagcggcactcgttgctgcccgtcaaaacaagaagaaaattgatatgcgcgacattgatgaagcaacggaccgtgtcattgcgggtcctgcgaagaagagccgcgtcatctcgaaaaaagaacgcaatatcgtggcgtaccacgagggcggtcacaccgttatcggacttgtgctggatgaagccgatatggttcataaagtaacgattgttccgaggggcaggcaggcggatacgcagtcatgcttccgagagaagaccgttacttccagacaaaacctgaacttctcgataaaattgtcggtcttctgggcggacgtgttgccgaggaaattatcttcggcgaagtcagcacgggggctcacaatgacttccagcgggcaacgaacattgccagaagaatggtgacagagttcggtatgtcagaaaaactcggaccgcttcagttcggtcaatctcaaggcggtcaagtattcctgggccgggatttcaacaacgagcaaaactacagtgatcagatcgcttacgaaattgatcaggaaattcagcgcatcattaaagaatgttatgagcgtgcgaaaaccatcctgactgaaaatcgcgataagcttgaattgattgctcagacattgcttgatgtggaaacattagatgcggaacaaatcaagcatctcgtggatcacggaaaactccctgagcgcaatttctcagatgaccatcttcaaaaagacgatgtgaaagtaaacatcctgtctaaaacagaagacgaaaagaaagacgagccgaaagaatagttcgctttctgatatgaaaaccgccggcgtataccggcggtttttttactggttccgttttgtttacaaaagagccgcagatcgtgtatggtattgtagaatgttgaaaatgttatgattagaaactattcaaaagtggtgatagaggttgttactggttatagatgtggggaacaccaacaccgtgattggtgtatatcatgatggggaattagaatatcattggcgcatagaaacgagcaggcacaaaacagaagacgaattcggcatgctgctccgctccttatttgaacattccggactgatgtttgaacagattgaagggattatcatctcatccgtagtgccgccgattatgttctctttagaaagaatgtgcacaaaatactttcacatcgagccgcaggttgtcggcccgggaatgaaaacaggtttaaatataaaatatgacaatccgaaagaagtgggagctgacaggatcgtcaatgccgttgcagcgatccagcagtatggcggccccttaattgttgttgatttcggaacggcgacgacgtattgctacattgatgaaaacaaacaatacatgggcggtgcgattgctcccggcattacaatttcaacggaagcgctgtactcacgcgcggccaagcttccgagaattgaaatcgcccgaccggataatatcatcggcaaaaacacggtaagcgccatgcagtccggcatccttttcggctatgtcggacaagttgaaggcattgtaaagcggatgaaatggcaggccaaacaagaaccgaaagtcattgcgacaggggggcttgcgtcattaatcgcaaacgaatcagactgtattgatattgttgacccgtttcttactttaaaagggctggaaatcatttatgagcgaaatcgcgtgggtcacatataggaggtaaacgatggattatttaattaaagcaattgcatatgacggtaaagtgcgggcttatgcagccagaacgacagatatggtaaatgaagcgcaaagaaggcatgacacgtggccgacggcatcagccgcaatcggccggacgatgacagcgtctctgatgctcggagcgatgcttaagggtgaagataagctgacagtcaaaatagaaggcggcggcccgatcggagccattgtcgcagatgcgaacgcaaagggtgaggtaagagcatacgtatcaaacccgcacgttcattttgacctcaatgaacaagggaaactggatgtcagacgggcggtcggaactgacggaacactcagtgtcgtaaaagatttgggcttgcgtgattattttacggggcaagtagagattgtctcgggtgaactcggtgatgacttcacgtattaccttgtttcttctgaacaagtcccttcatctgtcggggtaggtgtactagtaaatcctgataacacgattctcgctgcgggcgggttcatcattcagcttcttccggggactgatgaagaaaccatttcaacaattgaaaagcaattatctcaaatcgaaccgatttcaaaattgattcaaaaaggcctgacaccggaagaaatcttagaagaagttctgggtcaaaaaccggacgttctcgaaacaatgccggtcaaatttcactgttcttgttcaaaagatcgattcgaaacggccattttaggactaggcaaaaaagaaatacaagatatgatagaagaagacggaaaagccgaagcggtttgccatttttgtaatgagaaatatttatttacaaaagaagaactggaagagcttcgtgacgaaacaacccgctagctctttagcgggttgttctattttgtaaaagggatggggtagattttgaaatcgagaacacttttgacgattattgtagcggcgctgttggtatgcagtgtagcagtggcgtataagttaacaaaatcccaagccgcggggtcatctgaagaatccatcgcgacaatcggtgataaacatatcacacggcaggactggatgaaaaagatggaagacgagtacggaaaatcaactctggaggatatgattaatgcacaagtagtggaagaacttgcgaaaaagaataaactcacagtttcaaacaccgaattggaacgtgaatttcttttaatcaaagcggtgaataattcattttatgaagacagccatattaccgaaaaagaatggagagaccagatccgctacaacattcttcttgaagaactgctgacgaaggacatcgatatatcggataaggaaatgcaatcattttataataaaaataaagaactgtaccatttcgatgattcctacagaatcaggcacattgtcgtcaaaaacaaggaagaggcggacagggtgcttgctgatttgaaaggcggttccagctttgaagccgtcgccgctgagcgttccacggacagatacacgtctcagtatggcggagacctcggctttgtgacagaaaaccaggaaaatatcccgcaggcatatatcacagaagctaaaaatctcaaagaagatgaatggtccgctgaaccgattaaagtttcttcaggatatgccgtcattcagctgaaagaaaagcttaaagcgagaactttctcatacaatgaagtgaagagtcaaatcagacgccagatcgcgatggatcaattaggtgacaaggcgacagtcaaaacgctgtggaaagaggcgggggtctcttggttctacggggaaaaaagaactaaatgattgacaaaaaattttgaaattgataacttatatttataataccaataaatttagtcggaaattgaggtgtccaacatggtgcgtattgcaaattctattactgaactaatcggaaatactcctattgtgaaattgaatcgcctgacggatgaaaacagtgcagatgtatatctgaagcttgaatacatgaatccgggcagcagcgtaaaagaccgtatcggagcggcgatgattgaagcggctgaaaaagaaggaaaattaaaagccggcgacacaatcattgaaccgacaagcggaaatacaggaatcggtcttgcgatggtggcagcggctaaaggtctcagagccattctcgttatgcctgatacaatgagtatggaacgacgcaatctgctgcgcgcatacggagcggagcttgtgctgactcccggcgcagaaggaatgaagggcgccattaaaaaggcggaagaacttgcggaggaacacggatactttgtgcctcagcaattcaacaatgcggcaaacccggaaattcaccgccaaacgacggggaaagaaatcgtagaacagtttggtgacgaccagcttgatgcgttcgtggccggaatcggtaccggcggaaccatcacgggagcgggcgaagtgctgaaaaaagcatatccatccatcaaaatctatgcggtagagccggcggattctccagttctttccggcggaaaaccgggtccgcataaaattcagggtatcggagcgggatttgtccctgaaacattgaatacggacatctatgatcaaatcattcccgtcaaaaacgaggatgcatttgaatatgcccgtaaaacggcaaaagaagaagggattctcggcggtatttcttccggagcggccatttacgcggcactggaaatcgcgaaaaaactcgggaaaggcaagaaagtgcttgcgatcatccctagtaacggagaacgttacttaagcacaccgctttatcagtttgaatagagacatacacacggctcccggctgtatccgggagtttttttgtgcctgaagtatcgaaaatccaaaaaacgtttcgaattttatggttggaagtgaaattcacttttttcaccagtgtgattgctttaaaataaaactacagtaaaacgaagcagaggattgatatgatggcacaacgcagaccggcaggaagaaaaataccttttacgaaacaagcatttttacagcgatatgaaaacctttcgaaatcgagaaaacggcatgttctgctcgaaagcgcgagagggggaagattcagtatagccggtctagatccgattgcgtccgtcagagggaaagacggaattacaacgatcaagcatgagggagaaacactgtttaaagaaggtgacccgctgcgggcctttcatgaatggtttggaacgctcggaacggaaacaaacgttgagtttccggactttcagggcggtgcgattggttttatcagttacgactatgcccgatatattgagaattttaagatgctgtcgttagatgatctggaaacacctgatatttactttcttgtttttgatgatgtggccgtttatgaccatgaggaagaggcgttatggctcattacccatactgaagcggaagaagcggatcttgcggaagaaaagctgtccggcttagaggacatgtggtgttccctccaaacggcggacgagcctttttcaccgctgaatcggaatggggacggatcgtacgccgctccgttcaccgaggaaggattttcacaggctgtagaacaaattaaacaatatatcgcgagcggggatgtgttccaggttaatttgtccatcaggcagtctcagtctttatccgttcatccgtatgaggtgtataaacacttgcgaaacgtcaatccgtctccttacatggcctatctcgagacaccggggtttcaagtgatatgcgggtcgccggagctattggtgacaaagaaggggaagaagcttgaaacgagaccgatcgcgggtacgcgttcaagaggaaaagacgatgctgaagacaaggctttggctgatgaattaattcacaacgaaaaagaacgtgcggaacacgtcatgcttgttgatcttgagcgtaatgacctcgggcgcgtatcgcgctacggctccgtgcgggttaacgagtttatggcgatcgaaaaatattcccacgtcatgcatatcgtgtcaaacgtacagggagagctgcaggacggatatgacgcgacagacattattcatgcggtgttcccgggggcaccatcacgggagcgcccaaagtgagaacgatggaaattatagaagagcttgagccgacaagacgggggctttatactggatctataggctggttcggattcaacggagatttgcagtttaacattgtgatccggacgatctatgcagccggcggacatgcttttatgcagtccggagcaggagtggttattgattcggttccgaagcatgaatacaaggaatcgttcaaaaaagcttttgcgatgaaaaaggcgttagagctgagcgaagaagagacaaaaaatcagacgaggtgagcagagatgattttaatgattgacaattatgattcatttacgtacaacttggttcaatatttgggtgagctcggggaggaactgatcgtcagacggaatgacgagattacgattgagcagattgaagagctgggtccggacttcttaatgatttctcccgggccgtgcagtcctgatgaagcggggatcagcctcgaagccatcaaacattttgccggcagtattcctattttcggcgtatgtctcgggcatcagtcgattgcgcaagtattcggcggcgatgtcgtcagagcagagcggctcatgcacggcaaaacgtcagaagttatgcatgacggacagacgatttttaacggcctgcaaaatccgctggtcgccacccggtaccattcacttattgtcaaagcggacacgctgccggattgttttacggtatccgctcaaaccaaagaaggagaaattatggccatccgccataatgagctgcctgttgaaggtgttcagttccatccggaatccatcatgacctccttcggcaaagagatgctcagaaactttatagagacacaccgcaaaaaggaagtatcggtgtgattatatatttgaatggtcaatatatagaggagaaagaagcggcgctttctccttttgaccatggttatctgtacgggatcggagcgttcgagacgttcaggctttacagcggccggccgtttctgccggatgcgcatgtcgccaggctcaacagggcgcttcgggatctgcagattgcattcgaggtgaacaaacaggagctgcttgatatgcttcggagactgttgcttctcaatgacataaaggacggcagcgcgcgtgtccggcttaacatctcggcaggcgtcagcgataagggatttgccgcgcagacttatgaaaagccgaccgtcctttgtttcgtgaaccggctcaatccggaaactctgcctgttcaaaaagaaggcaggcttctctctgtccggagaaatacgcctgaaggatctttccggttaaaatcccatcactatttaaacaacatgtacgctaaacgggagatcgggaatgatcccaatcttgaagggattttcctgaccggagaaggagatgtcgcggaaggcattgtctccaacgtgttttggcgaaaaggagacaaggtctttacgccatctttggatacgggaattctcgacggtgtaacaagacagtttgtcattgatgaattgaaacggcaggggacagaagtcaccgaaggccgattccgttttcaatcaatgcttgaagcggatgaagcatggttgacaaactccgtgcttgaaatcatcccgttttctaaaatagaggaagtgccgctgcccggaatgagcgggaaaacggtgcaattgctccgtaagcagtatcggcaggaaataaacaaaatgaatgtacaggaggaggaacaaaatggcgcagcaaacaattgaacagcctaaactgattcatacaaaaaaaggcgctctgtcctataaagagaagacgctcgttatggggatattaaatgtaacgccagactccttctctgacggcggcaaatacgacagtacggaaagggcgcttctgcatgcggcgaagatggctgaagaaggggcgcatatcatagatatcggcggcgaatcgacaaggcccggcgcatcactcgtttcggctgatgaggaaatgtcacgagtcatccccgtcatagaacggattacaagcgagctggacattccgctttcaatcgatacgtacaaagcgtccgtggcagacgaagcggtcaaagcgggagcctctatccttaatgacatctggggggcgaaaggtgaccctgacatggcgtcagtagccgccgcacacggagttccgattatcttaatgcataatcgtatggaaagaaactataacgatcttattcctgatatgcttgcagacttgatggaaagcgtaaaaattgccgcagaagccggcgtcacagatgaaaacatgattctggatccggggatcggctttgcgaaaaactatgaggacaatctggctgtcatgaacaagctggaggtgttcagcgggttagggtatccgctgctcctggcgacatcgagaaaaaggttcatcggccgtgtgcttgaccttccccctgaagaacgtgccgagggaacgggagcgacagtatgccttggcgtccaaaaaggctgcgacattgtgagggtgcacgatgttaaagagatcgcaagaatgactaagatgatggatgctatgctgaacaaaggaggcgcgcattatggataaagtatatgtggaaggtatggagttttacggatatcacggcgtgttcgaggaagaaaacaaactcggccagcgcttcaaagtagacctgactgccgaactggatttgagcaaagcgggaaaaacggatgacctttcttataccattaactatgcggaattgtacagtgtctgccgcggcatcgttgagggcgagcccgttaatttggtcgagacccttgcggaacggatcgcagacaccgtccttgagaaatttgagccggtgcagcaatgtacggtaaaggttgttaagcctgacccgccgattcccggccattataaatcagtagccatagaaatgacgagaaagaaatcatgaacaatacggcatatatcggcctcggttccaatatgggcgaccgtgaacattatttgcgccaggcagtggccatgctcacccggcatgatggcgtgacggtgtcaaagatatcctctatatatgaaacagatcccgtcggttatgaggatcaggatcagtttctcaatatggcggttgaagtgaaaacgtcgttatctccttttgaacttctagatgtaacacagtccattgaagctgaattaggcagaacgagagagattcgctggggaccgcggacggcagaccttgacattttgctgtataatcgtgaaaatattgaaacagagcggctgattgttccgcatccgagaatgtatgagcgcttatttgtccttgcgccgttaaaagaaatatgtccgcaggcggatcatatcacgataagcgctgaaacaaaccaagaaggtgtaagagtatggaagcagaaatctggggtaggcgaattcgtgcattcagaaagctgaaaggttatactcaagaaggatttgcaaaagcattaggtatatcagtttctattgtcggtgaaattgaacgcggaaaccgattgccgtcagatgccatcattcaagatgcggcagatgttttaaatataagtgcggacgaattggccccgcctgaaaaatagacaaatgaaaggaggggaaaaatgtttaaaatcggtgatattcaattgaaaaaccgggttgtgcttgcccctatggccggtgtctgcaactcagcgttcagattgactgtaaaggaattcggagccggattggtatgcgctgaaatggtcagtgacaaagcgatcctttacaacaacgcaagaacaatggggatgctttacattgatgaacgtgaaaaaccgctcagccttcagatttttggaggaaaaaaggaaacccttgtggaagcggcgaagtttgtagatcaaaacacgactgctgatattattgatattaacatgggatgtcccgtaccaaagattacaaaatgtgatgcgggcgccaaatggcttctcgatcctgataagatttatgaaatggtatccgcagtagtagatgctgttgataagccggttacagtgaagatgagaatgggttgggatgaagatcacatttatgcggtgaaaaacgcccaagccgttgaacgtgccggcggaaaagccgttgcccttcacggccgcacaagagtgcaaatgtatgaaggcactgcgaactgggatatcattaaagaagtgaagcaatccgtctccattcccgtcatcggaaacggtgatgtcaaaacgcctcaggacgcgaaacgcatgcttgaggaaacaggagttgacggcgtcatgatcggccgggccgcactcggcaacccgtggatgatttaccgtacggtgcagtaccttgaaaccggtgagttaaaagacgagccgaaagtccgtgaaaaaatgtcggtatgcaaactgcacttagaccgcctgattaagttaaaaggcgaaaatgtggcagtcagagaaatgagaaaacacgctgcctggtatctgaaaggtgtcagaggcaatgcgaatgtacgcaatgaaattaaccaatgtgagacgcgtgaaaaatttgtgcagcttttagatgcatttaccgccgaagcagaggcaaaagagcttcaagatgcaaaagtaggttaatatacaccctctattgctgctcactgccagcttaccgctggcagtttttctgctttttcgtgaaatcaaaatgtaacggagtgataccaatgagtcaagaagagcaaaatcatgaggaattgaacgaccagctgcaagtcagacgagataaaatgaaccagctgagagaaaacggcattgaccctttcggcgaacgtttcgagagaacgcatcaatctcaacaaatcattgacgcctaccaggagctttctaaagaagaactggaagaaaaagcgatcgaagtgaccattgcaggccgtatgatgacaaagcgcggaaaagggaaagccggctttgcgcatctgcaggacttagaaggtcaaattcaaatttacgtaagaaaagacagtgtcggcgaagaacaatatgaaatctttaaatcttcagacctcggagacgttatcggcatcaccgggaaagttttcaaaacaaacgtaggcgagctttctgtcaaagcgacatcttttgaactgctgacaaaagcactgcgtcctcttcctgataaatatcatgggttaaaagacgttgaacagcgttaccgccagcgctatctcgatctcatcgtaaaccctgacagcaaacaaacgtttatcacacgcagcaaaatcatccaagcgatgagaagatacttagatgaccatggatacttagaagttgaaacacctacgatgcacagcataccgggaggagcgtctgcacgcccgttcatcacgcaccataacgcgctcgacatgcctctttatatgcgtattgcgattgaactgcacctgaaacgcctgattgtcggcggattggaaaaagtctacgaaatcggccgcgtgttccgtaacgaaggtgtttctacacgccataaccctgaattcacgatgatcgagctgtatgaagcgtacgccgattataaagatattatgagtcttacggaaaacctcgtagcacatattgcgcaggaagtgcttggaagcaccacaatccagtacggcgaagagcagattgatctgaaacctgagtggaaacgactccacatggtagatgcggtcaaagaagcgacaggcgtagatttctggaatgagatgactgttgaagaagcgcgcggtcatgcaaaagagcatggtatcgagatcacaaactctatgacggtgggtcatatcatcaatgaattcttcgaacaaaaaattgaagaaacactcattcagcctacatttatttacggccaccctgtagagatttctcctcttgctaagaaaaatccggaggaccctcgctttacagaccgttttgagctgtttatcgtcggccgtgagcacgctaatgcgtttacggagctgaatgaccctattgaccagagggaacgctttgaagcgcaattaaaagaaagagaagaaggaaacgatgaagcgcatatgatggatgaagacttcgttgaagctcttgaatacggcatgccgccgaccgggggattgggtatcggtatcgaccgccttgtcatgctgttaacaaatgctccgtctatcagagacgttttattattccctcaaatgagacaacgctaataaaagggaaggcgccgttttctgcttatcgcagtacggcgcttttttagaaacaagccgctcgtaaaactttttgattttctttaaaaaaactattgcactattatttgtgaggtggtatattattattcgttgccgctaaacaaggcgctgacgaaaaaaagaaatttaaaaagttgttgacttcaagagattgataagatataataataaagtcgcttgaacgaaagacaaaatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtgacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattcgattcttcgagatattgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgatttcctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatgggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagccattacacgtaagtgtaatatatggaggattagctcagctgggagagcatctgccttacaagcagagggtcggcggttcgagcccgtcatcctccaccatatttgccggcctagctcaattggtagagcaactgacttgtaatcagtaggttgggggttcaagtcctctggccggcaccatttttggacaagataataacacaagtcttttaaaaagagccattagctcagttggtagagcatctgacttttaatcagagggtcgaaggttcgagtccttcatggctcaccatgtaacgcgggtgtggcggaattggcagacgcgctagacttaggatctagtgtcttatgacgtgggggttcaagtcccttcacccgcattatacaggatagttatcctgtatgcggaagtagttcagtggtagaacaccaccttgccaaggtgggggtcgcgggttcgaatcccgtcttccgctccaactataccatccacgccggggtggtggaattggcagacacacaggacttaaaatcctgcggtaggtgactaccgtgccggttcaagtccggccctcggcattcattattatgcgcccgtagctcaattggatagagcgtttgactacggatcaaaaggttaggggttcgactcctctcgggcgcgccataatatttttaaaaatcgggaagtagctcagcttggtagagcacatggtttgggaccatggggtcgcaggttcgaatcctgtcttcccgaccacttcggggccttagctcagctgggagagcgcctgctttgcacgcaggaggtcagcggttcgatcccgctaggctccaccatttataaaaaaacatgttgactttaagagaaacttattatatacttaaaaagttgcttgagaaagtgaacaaaatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgcccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatattagacctcgggtcttataaacagtacgttccctgtcttgtttagttttgaaggatcattcgattcttcgagatgttgttctttgaaaactagataacagaagtaattcacattcaattgtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagatggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctatatttacggtaaaggcagctcatcatgagctgccttttttgtgtttttctgcatacgttatatagtatgagaaaagtaacgatatggctttttgcaaaagcaggttttatgcttgtgtaaagtggaaataatagagatagagcgatacagttgaaaaattttgcgaaacaccttatagtaagattaaagtcaaatatagtcaaagtcaataaaggagggggttgagtgggacataatatttctgacatcattgaacagtacttgaaacaagtattagatcaaaatggcaaagaaattttagagatcaaacgcagtgaaatcgctgataaatttcaatgtgttccttcccaaataaattatgtcatcaacaccagatttacaagtgaaagaggatatattgttgaaagtaaacggggaggcggcggttatattcgtattatcaaaattaaaatgaataacgaagtcgtcctcatcaataatattatttcgcagatccatacccacttgtcccaggcagcctctgatgacattattctcagactgttagaggacggagttatttcggaaagagaagctaaaatgatggtgagtgtaatggatcgttcagttctatatattgatttgcccgaacgggatgaactaagagccagaatgatgaaagcaatgctcacatctttaaaactaaagtaagcgggtgaaaagattgatttgtcaagaatgcaatgagagaccggccacttttcactttacgaaagttgttaatggagaaaagcaagaagttcatatttgtgaacaatgtgcaaaagaaaatagcgattcatacagtataagtggaaaccaagggttctcaattcataatttattatcaggactgctgaatatggagtcctcatttcaaaacaccggttctcaaatgttcggctactcagagcaaggcacagcttgtaagaaatgcggtatgacgtttcagcagctgagaaaaacagggcgtttcggctgtgcggaatgttacgatacgttctacagccaaattacgccgatcttgcgaaaagttcacagcgggaatacggtgcatgccgggaaaattccaaaacgaataggcggaaacctgcatgtaagacggcaaatggaaatgttaaaaaaagaacttgaatctttaatacaccacgaagagtttgaaagagcagcggaggtcagggatcagatccgatcgttagagcaggaattaaaaagtacagacagtgagggggaacaagggtaatgtcgctcaagcattttattcaggacgcactaagcaattggatgaagcaaaagggacctgaaagtgacattgtactcagcagccgtatacggttggcccgaaactttgaaaatataaagtttcccgcccggtatacgaatgaagaagcctcatccatcattcagcaattcgaagatcatttttcaggtaaggaactgcctgatatcggtcaatttcatttaatcagaatgagtgaagctcagcctttggaaaaacgggtgctgatggagaaacatctgatcagcccgaatttaacggaatctccttttggcggctgtctgctttctgaaaatgaagaagtcagcattatgttaaatgaagaagatcatatcagaattcaatgcctcttccccggcttccagcttctcaacgccataaaagcggcaaaccaggttgatgactggattgaggagaaagtggattacgcctttggagagaagagagggtacttaacaagctgtcctacaaatgtagggacgggactaagggcttcagtcatgatgcatttgccgggtcttgtattaactaggcaaatgaatcgaattataccggcaattaaccaattaggcttagttgttagaggaatttacggtgaaggcagcgaagcattaggaaatatctttcaaatttcaaatcaaatcacactcggaaaatcagaacaggacattgtagatgatttaaacagtgtggctgcccagctgattgagcaggaacgttcagcccgagaagcgctttaccaaacttcgaaaattgaattggaggaccgggtattcagatcttacggcgttttatccaactgccgtatgattgaatcaaaggaaacggcgaaatgcctttctgacgttcggctggggatagaccttgggatcatcaaagggctatcaagcaatatacttaatgaactgatgattttgacacagccgggttttctccagcaatattcgggcggtgcattacggccgaacgaaagagacgcgagaagagcggcgcttatcagggaaaggctgcatttagaaatgagtgcaaatagacaggaggatgattcgatatgatgtttggaaggtttacagagcgagctcaaaaggtattggcactggcacaggaggaagcactgcgcttaggccataacaatattggaactgaacatatcttattaggtctggttcgtgaaggagaagggattgcggctaaagcactccaagcactcggactcggttcggataaaattcagaaagaagtggagagcttaatcggacggggacaggaaatgtctcaaacgattcattatacgccaagagcaaaaaaagtcattgagctcagcatggatgaagccagaaagctaggacattcttatgtgggaacagaacacatacttctcggattgatccgtgaaggagaaggcgtggcggcgagagttctgaataatctcggtgtcagcttaaataaagcgagacagcaagtgctgcagcttctgggaagcaatgagacggggtcttctgcatccggtaccaacagcaatgcaaacacgccgacgcttgacagtctggcgcgtgatttaactgcgattgcgaaggaagacagtcttgatccggttatcgggcgaagcaaagaaattcagcgtgttattgaggtattaagccgcagaacgaaaaataatcccgttcttatcggagaaccgggtgtaggtaaaactgcgattgctgaaggcctcgcacagcagatcatcaataatgaagtgccggaaattttacgtgataaacgcgtaatgacgttagacatgggtacggttgtagccggtacgaaataccgcggagaatttgaagaccgcttgaaaaaagtaatggatgaaatacgtcaggccggcaatattattttattcattgacgaactgcatacactgatcggagcggggggagcagaaggtgcgattgacgcatcgaatattttaaaaccttcactggcccgcggagagcttcaatgcatcggtgccacaacgcttgatgaataccgtaaatatatcgaaaaagacgcggctctcgagcgccgtttccagccgattcaggtggatcagccgtcagccgatgaaagcattcaaattttaaaagggctccgtgaccgctatgaagcgcatcaccgcgtatccattaccgatgaagcgatcgaagccgcggttaaattgtccgaccgttatatttctgaccgcttccttccggataaagcgatcgatttaattgatgaagccggttcaaaagtgcgtctccgttctttcacaacgcctccgaacttaaaagagcttgagcagaaactcgatgaagttcgcaaggaaaaagacgctgccgttcagagccaggagtttgaaaaagcggcttcccttcgtgatacggagcagcgcctgagagaacaggtggaagacacgaaaaaaacctggaaagaaaaacaaggccaggagaactccgaagtttctgtagaggatatcgcgatggttgtatccagctggaccggggtgcccgtatctaaaattgcccaaacggaaacagataagcttctcaatatggaaagcattctgcattcccgcgtcatcggccaggatgaagccgttgtagccgtggcaaaggctgtcagacgtgcaagagccggactgaaggacccgaaacgtccgattggttcattcatcttcttaggccctacaggcgttgggaagacagagctggcaagagcgctggcggaatccattttcggtgatgaggaagcgatgatcagagtggatatgtccgaatacatggagaaacactcgacttcacgtcttgtcggttctcctccgggatatgtcggctatgatgaaggcggccagctgacagaaaaagtgagaagaaaaccttactctgtcgtattgcttgatgaaattgaaaaagcacaccctgatgtgtttaacattctcctgcaagtgcttgaagacggacgcttgactgattcaaaaggacgcactgtggatttccgcaacacgatcctgattatgacgtcaaacgtcggggcgagcgagctgaagcgcaacaaatatgtaggcttcaatgtccaggatgaatcacaaaaccataaagacatgaaagacaaagtcatgggagagttgaagcgtgccttcagacctgagtttatcaaccggattgacgaaattatcgtcttccactcccttgagaaaaaacatcttacagacatcgtgtcgcttatgtctgatcagttaacaaaacgtctgaaagaacaagatctctctatcgagctgacggatgctgccaaagcaaaagtagcagaagagggcgtcgatttggaatacggcgcacgtccgttaagaagagcgattcaaaagcatgtggaggaccggttatcagaagaactcctcagaggcaatattgataaaggccaacacattgttcttgatgttgaggacggcgaatttgtcgtaaaaacaactgctaaaacgaactaatatagtgacaaacatgaggcatacgtaagcgagtgtatgcctcactttgttatatagagaaatattcgataaggaagaggtcttacaacatatatggctaaatcaaaaacaaaattcatctgccactcatgcggttatgaatccgcaaaatggatgggaaagtgcccgggctgcggggcttggaatacaatggtggaagaaaccataaaaaaagcgccggcgaatcggcgggcggctttctcccactccgttcaaaccgtccagaaaccatcacccattacatcaattgaaacatcagaagaaccccgcgttcaaacaaagctcgaagaattcaacagagtgcttggcggcggcgttgtgaaaggctcgttagtattgatcggcggcgatcccgggatcggaaaatcaacgctccttctccaagtatccgcacaattagcagatacggccggcagcgtgctttacatttcaggggaagaatccgtgaagcaaacgaagctgcgcgccgacagacttggcatcaacagccaaatgttacatgttttatctgaaaccgatatggagtatatttcgtctgctatacaagagatgaaacccgcatttgttgtcgtagactccattcagaccgtttaccaaagtgatatcacctcagctcccggcagtgtatcacaagtaagagagtgtacggccgaattgatgaaaatcgcgaaaacaaacggcatacctatttttatcgtcggacacgtcacaaaagaaggatcgatcgcagggccgagattgcttgagcacatggtcgataccgttctatactttgaaggagagcggcatcatacattccgtattttgcgggccgtaaaaaaccgtttcggctcaacaaatgaaatgggcatctttgaaatgcgggaagaggggcttacggaagtgctcaacccttctgaaattttcttggaagagcgttctgccggggcatcgggttcgagtatcgttgcgtcaatggaaggaacgagaccgattctggttgaaatccaggcgctcatatcaccgaccagttttggaaacccgcgccgcatggctacaggcattgaccacaacagggtatcgttaattatggctgtgcttgagaagcgggtgggtcttttgcttcaaaatcaagatgcatatttaaaagtcgccggcggggtcaaactggatgaaccggcgattgatttggcagtagccgtcagcattgcctcaagcttcagagatacaccgccgaatcccgcagattgctttatcggtgaagtgggactgacaggagaagtccgcagggtgtcaagaatcgaacagcgcgtaaaagaagcggcgaaactcggcttcaagcgcatgatcatacctgaggcgaatgcagatgggtggacaataccaaaagggattgaggttgtcggagtagcaaatgttgcagaagcgcttcgtacttcattaggaggatcataatagatggaaaaagagaaaaaaggggcgaaacaagagcttgacctgtctgcaattctgcagttcgttgcaccgggcaccccgctcagagccgggatagagaatgtacttcgggcaaatacaggcggcctgattgttgtcggatacaatgataaggtaaagcaagtcgtcgatggcggttttcatattaatacatcatttgcgcccgctcacttatacgagctggccaaaatggacggtgccattattttaagtgattccggccagaaaattctttatgcgaatacacagcttatgccggaggcgaccatttcttcttcagaaacgggaatgaggcaccgtacggcggaacgggtggcgaagcagaccggctgtctcgtcatcgccatttctgagcgcagaaatgtcattacgttatatcaggacagcatgaagtacacactaaaggacataggttttattttaacaaaggcaaatcaggccattcaaacgctcgagaagtataaaaccattttagacaaaacaattacggctctaaacgcattagagtttgaggagcttgtgacattcagtgacgtgctgtctgtcatgcatcggtatgaaatggtgctccgaataaaaaatgaaatcaatatgtatattaaagaactcggaacggaaggacacttaatccgtctgcaggtgattgaactgattacggacatggaagaagaggcggcacttttcatcaaagactatgtcaaagaaaaaatcaaagatccgttcgtgctgttaaaagagctccaggatatgtccagctatgatctgctggatgattccattctgtttaaactgcttggatacccggcttctacgaatcttgatgattatgtgctcccgagaggctacaggctgctgaacaaaattccgcgtctgccgatgccgattgttgaaaatgtggttgaggcgttcggatttttgcccagcataacggaagccactgtagaagagcttgatgatgtcgagggtatcggcgaagtgcgcgcccaaaaaatcaaaaaaggcttaaaacgccttcaggaaaaacactatatagatagacagctttaagtatcgcttaaacctgtcggaatccgggtatattattgttagtttttgtttattctgaatttgtaggctctgacagtctgctgaaaaaatgctacttaaaaggaggtggaggtatgttaaaacgaatagttcaggcgttcttcattattgtgggcggcgttgtcggtatctttttaatacctgaattgtttgtgctgtcaaatatacaggacatacctttaataacaaacgcatatacgtctgctgcaattggtgctattatcttttttctcatcagtatatggacgacagaatatgtgattaattgggtaaaatggattgaagattctttgctgagagctccggtgccggatctgttattcgggagtctcggattggtttttggacttatcatcgcatatctcattgtaaacgtgattccgctggacaatattccgtaccgtatattcagcaccatcattccggtctttctggctttctttctcggttatctgggcttccaagtcggatttaagaaaaaggatgaactgatcagtcttttctccatttctgcaagaatgcagaagaaaaagggaagtgctgatgaggagcaggaagaacaggataaaaggctgaaaatcttggatacaagtgttattattgatgggagaattgcagatatttgtcagacgggctttttagaaggcgtcattgtcattcctcaatttgtgctggaggaattacagcatatcgctgattcttcagatgttttaaaacgtaacagaggacgccgcggactggatatcttgaatcgcattcaaaaggaactggatattacggttgaaatttatgaaggcgacttcgaagacattcaggaggttgacagcaagcttgtcaaacttgcgaagctgacatccggtgtcgttgtgacgaatgattttaatttaaataaagtatgcgagcttcaaaaggttgcggtactgaatattaatgaccttgcaaacgcggtgaagccggttgtgcttccgggcgaagagatgaatgtgcaggtgattaaggacgggaaagagcataatcaaggtgtggcttacttagatgacggcacaatgattgttgtggaagaaggccgcaattatatagggaaacatattgatgtgctcgtaaccagcgtactgcagacagcggcgggacgaatgatttttgccaagcccaagctgcttgagaaagctctttaagagggagttcatatggagtatgttgtcgttattccggctgccggacaaggaaaacggatgaaggccgggaaaaataagctgttcatcagcttaaaaggtgcgcccgttattatacacacactgcgggtttttgaaagccacgcaccctgtcagaaaataatcctggtgataaacgagagtgaacgggaagattttcgccagctgctggtccaatttccgattcagacggaaattgagcttgttaccggaggtgcggagcgtcagcacagtgtatacgaaggactgaaagtgattgataaggaatcggtcgtgcttgttcatgacggagcgcgcccgtttgtcacacatcagcatatcgataagctcgttgaaacagcagaggaggcgggagcggctgtcctggctgttcctgtgaaagacacgataaaacgggcggaaggctcccgggctgcggagacctttgatcgttcaagcttgtgggccgttcaaacgccgcaagcttttcgtctttctttattgaagacggcgcatatggaagcggaaaacaaaggcttcttaggtacggatgacgccagcctcgtcgagcgtcttgatggatatcaggtgagtatcgttgaaggcagctataccaatattaagctgacaacgccggatgacctgatatttgcggaagcaatcatgaaagcggaaagtgggaatcataatgtttagaatcggacaaggatttgatgtgcatcaattaacggaaggccgtccgctcatcatcggcggaattgaaattccttatgaaaagggactgctcggacattcagatgctgatgtattgctgcatacagtcgcagacgcgtgtctcggagcggcaggtgaaggagatatcggcaagcatttcccggatactgatccggaattcaaggatgctgattcttttaagctgcttcagcatgtctggaacattgtaaaagaaaaagggtacgtactcggaaatatagactgcacgattattgcgcaaaagccgaaaatggcgccgcatattgatgctatgagaaaacggatagcggaaggccttgaggcggacgtctctcaagtaaacgtaaaagcgacgacgactgaaaagctcgggtttaccggaagagccgaaggaattgccgctcaggcaaccgttctgattcaaaaagcctgatcattgttttgatgccgggtctatttggtggtagaatagatacatatattcggctagaggctacagacgagatgaaaggaagtatttgaacatgggaaatgaagtacgcgttcgttatgcaccgagtccgaccggacatttgcatatcggtaacgccagaacggcgctttttaactatttatttgcccgcagccaaggcggaaagtttattatccggattgaggatacggacaaaaagcgaaatattgaaggcggagagcaaagtcagcttaactatttgaaatggctcggcatggactgggatgaaagtgtggatgtcggcggagaatacggcccgtaccgccagtctgagcgtaacgacatttacaaagagtactatgaagagcttcttgaaaaagggcttgcttataaatgtttctgtacggaagaagaacttgaaaaagaacgtgaagagcaaatcgcccgcggggaaatgccgcgctattccggcaaacacagaaacctgactcaggaagagcaggagcagtttttagccgaaggcagacagccgagcatccgtttccgcgtgccggaagggaaaatcatcgcatttaacgatatcgtaaaaggcgagatttcttttgaatcagacggcatcggcgactttgtcatcgtcaaaaaagacggaacaccgacgtataactttgccgtcgcgattgacgattacttaatgaaaatgacgcacgtgctccgcggtgaggatcacatttcaaatacaccgaaacagatcatgattttccaggcattcggctgggatattcctgtcttcggacatatgacgcttatcgtaaacgaaagccgcaaaaaattaagtaaacgtgatgaatcaattatccagtttattgagcagtatgatgagctgggttacctgcctgaagcgctgtttaactttatcggacttctcggctggtctcccgtcggtgaagaagagcttttcacaagagaacaattcattgaaatttttgatgtaaatcgtttgtctaagtcaccggctctgtttgatatgcataaactgaaatgggtcaacaaccaatacgtcaaagcgctggatcttgatcaagtggttgagctgaccctgccgcacctgcaaaaagcaggaaaagtcggcactgagctttctgccgaagaacaggaatgggttcgtaaattaatctctctttaccatgagcaattgagctacggcgctgaaattgtcgagcttactgatttgttctttaaagatgagatcgagtataatcaagaggcaaaagccgttctggaagaagaacaggtgcctgaagtgctcagcgtatttgctgcgaagcttgaagagcttgaagaatttacgcctgagctgatcaaagcctcaatcaaagctgttcagaaagaaacaggccataaaggcaaaaagctgttcatgccgattcgtgtagcggttaccggtcagacacacggtccggagcttccgcaggccattgagctgatcggcagagaaacagccgtcagacgcctgaaaagcatttaaatatacgattgttgacagggaagagtataaaacaatgaccattacagaaagaatcttcatcggctgagagagattcatgcgtcatgttttagaagtgcgcccttaagacctttgaagaacatttctgcggaaatcagtatttaaaggcggccgccgccgttaccggcttttaagttgggaaaacattgacttgtttttcaaacagagtggaaccgcgcggtaaaagcgtctctgtcatgtttacatgcagaggcgctttttttataggcggaaaaacagactggagcggggagagaatggggggaagcatgtgttttttaaaatgctaaaagaagacatagatacagtgttcgatcaagatccggcagcaagaagctatttcgaagttgttttaacttattctggtttacatgctatatgggcgcatcggattgcacatgctttatataaacggagatttttcttcctggcgcgcctgatatcacagattgcccgtttctttaccggaattgaaatccatcccggcgcgaccatcgggagaaggtttttcattgaccacggtatgggggtcgtcataggggaaacatgtgaaatcggcaataacgtgacggtattccaaggtgtcactctcgggggaacgggaaaagaaaaggggaagcggcatccgaccataaaagatgatgctttaattgcaaccggagcgaaggtgctcggctctattacggtcgggcagggttctaaagtaggggccggctccgttgtgcttcgtgatgttcccgacttttcgaccgttgtcggcataccggggaaagtcgtcattcagaacggaagaaaaatcaaacgcgatctcaatcaccaagacttgcccgatccggttgctgaccggtttagagcattggagcagcagatttttgaactgcaggctgaactggaagataaaaaagaaaggatcaaccaaaaatgaccattacactttataatacattgacacggaaaaaggaaacatttgttcctcttgaggaaggcaaagtaaaaatgtacgtgtgcggacctactgtatacaactatattcatatcggaaacgctcgtccggcgattgtgtatgataccgtacgcaactatttggagtataaaggatacgatgttcaatacgtatcgaatttcaccgatgttgacgacaaactgattaaagcggccaacgagctcggcgaggacgtcccgaccgtttctgaacggttcattaaagcgtattttgaagacgtgggcgccctcggatgccggaaagcggatcttcacccccgggtcatggaaaacatggacgccattattgaatttgtcagcgagctgattaaaaaaggctacgcttatgaatcagaaggcgacgtctatttcaaaacaagggccttcgaaggctacggcaagctatctcagcaatcaattgatgaactcagatcaggcgcgcgtatccgtgtcggcgagaagaaagaggatgcgctggactttgcgctttggaaagctgctaaggacggagaaatttcatgggatagcccttggggaaaaggccgcccgggctggcatattgaatgctccgcaatggtgaaaaagtatttgggtgacgaaatcgatattcacgccggcggtcaggacctgacattcccgcaccatgaaaacgaaatcgcgcaatctgaagcattaacaggcaagacattcgcaaaatactggcttcacaacggatatatcaatatcgataatgagaaaatgtcaaaatcgctcggcaactttgttttggtgcacgatatcattaagcaatatgacccgcagcttttgagatttttcatgctttccgttcattaccgccacccgatcaactattcggaagagctgcttgagaaaacaaaaaacgcgtttaaccgcctcaagacggcatacagtaatttaaaccatcgtttgattagcagcacgaatctgactgacaatgatgaggaatggctcgctaaaatcgaagagcaccgcgcttcgtttgaagaagcaatggatgatgattttaatacggcgaatgcgatttccgtttggtttgatctggcgaagctcgccaattactacatgcaggaagacaatacggcggatcacgtcattaaagcctttatcagcatgtttgacagaatcggatctgttctcggacttacgctcggcgaagaagagcttgtcgacgaagagattgaagagttgattgagaagagaaatgaagcccgccgcaatcgcgatttcgctttgtcagaccagattcgcgatcagctgaaaagcatgaatatcattcttgaagacacagcccagggaactcgctggaagcggggagaataagcggatgcttcaatttgaacaaatcaaagattcaaagcagttaaacggtcttgcgcttgcttatatgggtgatgccatttttgaaatatacgtccggcatcacctgcttaagcagggctttacgaaaccgaatgaccttcataagaaggcgagccggattgtatcggcaaaatcacaggcagacatattgttccgccttcaggacgaatcctttttcacggaggaagaggaagccgtgctgagaagaggcagaaacgcgaaatcagggaccacgcctaaaaacacagatgtacagacgtaccgccatagtacagcttttgaggctttactcggatacctttttcttgagaaaagagaagaaagactgaatcagctgattgctgaggctatacaagtcgggacgtcagggaggaaaacaaatgagtcagcaacatgattacgtcataggaaaaaacgctgtgattgagacgttaaagtcagatcgcaagctgtataagttatggatggcggaaaacacagtaaaaggacaggcgcagcaagttatggagcttgctaaaaagcgcggcgtcaccattcaatttgtaccgaggaaaaaactcgatcagatggtggaggggcagcatcagggtgttgtcgcccaggtggcggcatatgaatatgcacaattagacgaattatataaaagagcggaagagagaaacgaacagcctttctttctcatattggacgagctggaagaccctcataatctcggttccatcatgagaacggctgacgctgtcggtgcacacggcattgtgattccgaaacgcagagcggtcggactgacatcgacggtcgcaaaagcttcgaccggtgcgattgaacacattcccgtcgtgaaggtgaccaaccttgcccggacacttgatgaaatgaaggagcgggggatttgggtcgtcggaacggatgcatccgcccgggaagactaccgctctatggacggcaagatgcctttggcgctcgttatcggaagcgaaggcagaggaatgggccggcttgtgaaagagaaatgtgattttctcattaaacttccgatggccggaaaagtcacgtctctgaatgcgtcggtagcggccggccttctcatgtatgaagtctaccggaagcgcaatcctttaggggaataatgacagatggacatcctgttagtagacggatacaacatgattggagcttggccgcagctaaaggatttaaaagcgaacagttttgaagaagcgagagatgtactgatccagaagatggcggaatatcagtcctacacgggaatcagagtcattgtggtgtttgacgcacatctggtaaaaggcatagagaaaaaacaaacgaatcacagagtcgaagtgatttttacacgggagaatgagacggcggatgagcggatcgagaaacttgcccaggcgctgaataatattgcgacacagattcatgtcgcaacctccgattatacggagcagtgggcgattttcggacaaggggctctccgcaaatccgcccgggagcttctgagggaagtggatacgatagaacggcggattcaaaggcgggtttcaaagatcacttctgaaaaaccaccgggtaaaatcgagctgtccgaagaggttttgaaaacgtttgaaaagtggcgccgaggcggtctggattaggttgacgctttttcgcccattaatgtataatatttctatctacgtgcgccggggggatcgcagtgaatctacagaacagcaagggaaagttcaacaaagtgcaattttgccagttggaggacgagcaggtcattgaaaaggttcatgttggggatagtgatgcgttagattacttgattacgaagtaccgtaattttgtacgggcgaaagcaaggtcttattttttaataggggccgacagagaagatattgtacaggaagggatgataggcttatataagtctatccgagactttagagaggacaagcttacttcatttaaagcttttgcagaattatgcattacccgccagattattaccgcaataaagacagctacccgtcagaaacacattcctttaaattcctatgtttctttagacaaacctatttttgatgaagaatctgacagaacactgcttgatgtcatttcaggcgctaaaacgttaaatcctgaagagatgattattaatcaggaagaatttgatgatatcgaaatgaaaatgggagaactgctgagcgatctggagagaaaggtgcttgttctgtacttggacggaagaagttaccaggaaatttcagatgatttaaaccgacacgtaaaatcaatcgataatgccctgcagcgcgtgaagcgcaagcttgaaaagtatttggaaataagagaaatcagtctgtagcgggtttctgtgtcatattgacagaatttttctgactgtgctattttattaagataaatgattgtttaggaaaaggtgtaacgacatgagaaaaaagattacgctggcatgcaaaacatgcggaaatcgtaattatacgacaatgaaaagctctgcatcagcggctgagcggttagaagttaagaagtactgcagcacttgcaattcacatacagctcatttagaaacaaaatagtgttcgctttttaaattgtggaggtcttttacatgcgcatgatgagtttctttaaagatgttgggaaagaaatgaaaaaggttagctggcctaaaggcaaagagttaacgcgctatacgatcacggtgatttcaacggttatcttttttgttatcttttttgccctccttgatacaggaatttctcaattaattcgtttaatagttgaataatgatcagcaatacgtgctataatagatcataatatcgtttgccaaaacccgttcagcgggttttttattgtgttgaaaaaaggattcataggctctgagcctattttttgttttacacttcatttttaaatgcggggagggaaggactgcagagtcctgatagaatggaaaagaattggtatgttgttcatacgtattccggttatgaaaacaaagtaaaagcgaaccttgaaaaacgtgtggaatcaatgggaatgcaggataaaattttccgcgttgtcgtccctgaagaggaagagactgatattaagaacggcaagaaaaaagtagtcaaaaagaaagtgttcccgggttatgtgcttgttgaaatcgtcatgactgatgattcctggtatgtggtccgcaacacgccgggcgttaccggattcgtcggatcagccggttcaggctcaaagccgactccgcttcttcctggcgaagcggaaaccatcttaaagcggatgggcatggatgagcggaaaaccgacattgattttgaattgaatgagacagtcaaagtcatagacggacctttcgccaactttacaggatcaattgaagagattgattatgataagagcaaagtgaaagtattcgttaacatgttcggccgtgaaacgccggttgagctggaatttacccagatcgacaaattgtaatgtgaaaaaacttgaaattgctatatattaatgataatatagcaaaggtacgtcttggactaatccaaggcagctagcttgatatttcgtcattcatataaagaatgaaaccttgagtgggagggtttaccctattaccacatcacggacttaaggaggtgtgtctcgtggctaaaaaagtagtaaaagttgtaaaattgcaaattcctgctggaaaagctaacccagcgccgccagttggacctgcactaggtcaagccggtgtaaatatcatgggattctgtaaggagtttaacgctcgtacagctgaccaagctggtttaatcattcctgttgaaatttcggtttacgaagaccgttcatttacatttattacaaaaactccgcctgctgcagtattgcttaaaaaagcagctggaattgagtctggttctggtgaaccaaaccgtaataaagtggcaaccgttaagcgcgataaggttcgcgaaatcgctgaaacgaaaatgcctgacttaaacgcagcagacgttgaagcggcaatgcgcatggttgaaggtactgcccgcagtatgggtatcgttatcgaggattaatttgtttcttgtcgggttgcgagttttcacaagttcgcaacccttattcgtgggaggttattccgctataaccacataaggaggaaattttaaaatggctaaaaaaggtaaaaagtacgttgaagctgcgaagcttgtagaccgtgcgaaagcttacgacgtcgctgaagcagtggcgcttactaaaaaaacaaacacagctaaattcgacgctacagttgaagttgcttttcgtttaggggttgaccctcgtaaaaacgatcagcaaatccgcggtgcagttgtacttcctaacggaactggtaaaactcagcgcgtgcttgtattcgctaaaggcgaaaaagcaaaagaagctgaagctgccggtgcagactacgtcggtgattctgattacatcgcgaaaatccagcaaggctggttcgaattcgatgtaatcgttgcgactcctgacatgatgggtgaagtcggtaaaatcggccgtgtgcttggaccaaaaggtcttatgccaaaccctaaaacaggaactgttacattcgaagtagaaaaagcaatcggcgaaatcaaagctggtaaagtagaataccgcgttgacaaagctggtaacatccatgttccgatcggaaaagtttctttcgaggatgaaaaacttgttgagaacttcacaacaatgtatgatacaatcctgaaagcaaaaccggctgcggctaaaggtgtttacgtgaaaaacgttgccgttacttctactatgggccctggtgtcaaagtagacgcttctactttcaacgtaaaataatatttgactttagatcagcattctgatatgattcaaaatgttgtaaaatataatatgtcatttataccgtagacagcaggggccgttgaggcttaatatcctgccgaggtgtatatatatcacagctattacgttacgtatgcttgtatatacagcctccatgtccacatggaggctttttatatgaaatcgtcgtcacagtcgtgatcacctagcggtataagtgttacacaaaatctacaggaggtgtaaccatgagcagcgcaattgatacaaaaaaagttgttgttgaagagattgcttctaaactgaaagaaagcaaatcaacgatcatcgttgactaccgcggacttaacgtttctgaagtaactgaactccgtaaacagcttcgcgaagctaacgtagagttcaaagtgtacaaaaacacaatgactcgccgtgcggttgaacaagctgaacttgatggtttgaatgatgtcttaactggaccgaatgcgatcgcattcagtactgaagatgttgtcgctccggcaaaagttcttaacgagttcgcgaaaaatcacgaagctctggaaatcaaagcgggcgttatcgaaggaaaagtatcttctgttgaagaagtgaaagctcttgctgaacttccttcacgcgatggcttactttctatgttgcttagcgtacttcaagctccagttcgcaaccttgcacttgcagctaaagcagttgcagaccaaaaggaagaacaaggcgcttaatctgattttaccctaaaataaaacaaatggaggaatttcaaatggctttaaatatcgaagaaatcattgcttccgttaaagaagcaactgtacttgaattgaacgacctagtaaaagcaatcgaagaagaatttggcgtaactgctgctgctcctgtagctgtagctggcggagctgctgctggcggcgctgctgaagagcaaagcgaattcgaccttatccttgctggtgcaggttctcagaaaatcaaagttatcaaagttgttcgtgaaatcactggtcttggcttgaaagaagctaaagaacttgttgacaacactccaaaaccacttaaagaaggtattgcgaaagaagaagctgaagagcttaaagctaaacttgaagaagttggcgcttctgtagaagttaagtaatcttcacttgcctgtaggggaagctcgcttttatgaggcgggctttttctttgcttttctttaagtgcaattaaaaaaggaggttctaataatgagtgaacactattattcagaaaaaccttcagttaaaagcgataaacagacatggtcatttacactgcggaacagatcttatacattcacaagtgacagcggcgttttctcgaaaaaggaagttgatttcggttcgcgtgtcttaattgaagcgtttgaagagccggagatcgatggtgacttcctggatgcaggctgcggttacggcccgatcggtctgtcgctcgccggtgcatttacagaccggaccgtgcacatgattgacgtgaatgaaagagccgtagagctgtcaaatgaaaatgcagaaaaaaacggaataaaaaacgttcggatttatcagagtgatttattttcaaatattgattctgctcaaacatttgcttctattattacaaaccccccaatccgcgccggaaaaaaagttgtccatgccatttttgaaaaaagcgctgagcatttaagggcttcaggtgaattgtggatcgttatacagaaaaaacagggcgggccttctgccattgaaaaactgaaggagctttttgacgaagtttctgtggttcaaaaaaagaaaggctattatatcataaaagcaaaaaaagtttgacttgaattttcagctatgttaatattgtaaaatgccaatgtatatattttgcatgatatgctcaaataatcatagtgcatgtataaattatacaaacatggaaatgctaataaaatcggtatttgtttttggatgtggttttcttaattagaaacccttttttcttttgtcttgtaaaagtatttctttatcgtaagagatgcttattacacatataatacgcatgatttgaggggtgaatcagttgacaggtcaactagttcagtatggacgacaccgccagcgcagaagctatgctcgcattagcgaagtgttagaattaccaaatctcattgaaattcaaacctcttcttatcagtggtttcttgatgagggtcttagagagatgtttcaagacatatcaccaattgaggatttcactggtaacctctctctagagttcattgactacagtttaggagatcctaagtatcccgttgaagagtcaaaagaacgtgatgtgacttactcagctccgctaagagtgaaggttcgtttaattaacaaagaaactggagaggtaaaagaccaggatgtcttcatgggtgatttccctattatgacagataccggtacttttatcatcaacggtgcagaacgtgttatcgtatctcagcttgttcggtctccaagtgtatatttcagtggtaaagtagacaaaaacggtaaaaaaggttttaccgcgactgtcattccaaaccgtggcgcatggttagaatacgaaactgatgcgaaagatgttgtgtatgtccgcattgatcgcacacgtaagttgccggttacggttcttttgcgtgctctcggcttcggttccgaccaagagattctcgatctcattggtgagaacgaatatctccgcaatacactggataaggacaacaccgaaaacagtgacaaagcgcttcttgaaatctatgagcgccttcgtcccggagagccgcctacagtagaaaacgcaaaaagcttgctggattcccgtttcttcgatccgaagcgatacgaccttgcgaatgtaggacgctataaaattaataaaaagcttcatatcaagaaccgcctgtttaaccagcgccttgcagaaacactggtggatccggaaaccggtgaaattctcgctgaaaaagggcagattcttgacagaagaacacttgataaagtattgccatacttagaaaatggaatcggcttcagaaaactttatcctaacggcggcgttgtcgaggatgaagtgatgcttcaatccattaaaatctatgctcctactgatgcagaaggagagcagacgatcaatgtgatcggcaatgcttacatcgaagaggcgattaaaaacattacgcctgctgatattatttcttctatcagctacttcttcaacctcctgcacggagtgggcgacactgatgatatcgaccatctcggaaaccgccgtctgcgttctgtaggtgagctcctgcaaaaccaattccgtatcggtttaagccggatggaacgtgtcgtacgtgaaagaatgtctattcaagacacgaatacaattacgccgcagcagctgattaacatcagacctgttattgcgtctattaaagagttcttcggaagctcacagctttctcaattcatggatcagacgaacccgcttgctgaattgacgcacaaacgccgtctgtcagctctcggaccgggcggtttgacgcgtgagcgcgcaggtatggaagtacgtgacgttcactactctcactacggccgtatgtgtccgattgaaacgcctgagggcccgaacatcggtttgatcaactcattgtcatcatttgcgaaagtaaaccgctttggtttcattgagacgccataccgccgcgttgatcctgaaacaggaaaagtaacgcctagaatcgactacctgactgctgatgaagaggataactatgtcgtagcccaagcgaatgctaagctgagcgatgacggttctttcttggatgacagcatcgtagcgcgtttcagaggggaaaacaccgttgtagcccgcaaccgcgtggattacatggacgtatctcctaaacaggttgtttctgctgcgacagcatgtattccgttcttggaaaacgatgactcgaaccgcgccctcatgggagcgaacatgcagcgtcaggctgtgcctttgatgcagccggaagctccgatcgtcggaacgggtatggaatacgtatccggtaaagactccggtgcagccgttatttgtaaacaccctggtatcgtagaacgggtggaagcgaaaaacgtatgggtgcgccgctatgaagaaattgacggccaaaaagtaaaaggcaacctggataagtacagcttgctgaaatttgtccgctccaaccaaggtacgtgctacaaccagcgtccgattgtaagtgtcggcgatgaagtagtcaaaggagaaatccttgctgacggaccttcaatggagcttggtgaacttgctctcggccgcaacgtaatggtcggcttcatgacatgggacggttacaactatgaggatgccatcatcatgagtgaacgccttgtgaaagatgatgtatacacatctattcacattgaagaatatgaatcagaagcacgtgatacaaagcttgggccggaagagatcacccgcgatattccaaacgtaggggaagacgcgcttcgcaaccttgatgaccgcggaattatccgtatcggcgcggaagtcaacgacggagaccttctcgtaggtaaagtaacgcctaaaggtgtaactgagcttacggctgaagaacgccttcttcatgcgatctttggagaaaaagcgcgtgaagtccgtgatacttctctccgtgtgcctcacggcggcggcggaattatccacgacgtaaaagtcttcaaccgtgaagacggcgacgaacttcctccgggagtgaaccagcttgtacgcgtatatatcgttcagaaacgtaagatttctgaaggtgataaaatggccggacgtcacggaaataaaggggttatctcgaagattcttcctgaagaagatatgccttaccttcctgacggcacgccgatcgatatcatgcttaacccgctgggtgtaccatcacgtatgaatatcggtcaggtattagaacttcacatgggtatggctgcccgctacctcggcattcacatcgcgtcacctgtatttgacggcgcgcgtgaagaagatgtgtgggaaacacttgaagaagcaggcatgtcaagagacgctaaaacagttctttatgacggccgtacgggagaaccgttcgacaaccgtgtatcagtcggaatcatgtacatgatcaaactggctcacatggttgacgataaacttcatgcccgttctacaggtccttactcacttgttacgcagcagcctctcggcggtaaagcccaattcggcggacagcgtttcggtgagatggaggtttgggcgcttgaagcttacggcgcagcttacacgcttcaagaaatcctgactgtgaagtccgatgacgtggtcggacgtgtgaaaacatatgaagccatcgtcaaaggcgacaatgttccagagcctggtgttccggaatcattcaaagtattgatcaaagagcttcaaagcttaggtatggacgtaaaaatcctctcaggcgatgaagaagaaatagaaatgagagatctagaagacgaggaagatgcgaaacaggctgacggccttgcattatcaggtgatgaagcgccggaagaaacagcatctccagacgttgaacgtgacgcagtaacgaaagaatagtctctgattgataaaggcaagtgacatcggttaatccgaagataaaaagggaggtaggccccttgctagatgtgaacaattttgagtatatgaacatcggtcttgcttcaccggataaaatccgttcatggtcttttggtgaagtgaaaaagcctgaaacgataaactatcgtacgttgaaacctgaaaaggacggcctgttctgcgaacgcattttcggaccgactaaggactgggaatgtcattgcggcaagtacaagcgggttcgttataaaggcgtagtttgtgaccgttgcggagttgaagtaacgcgggctaaagtccgtcgtgagagaatggggcatattgaactggctgccccggtttctcacatttggtatttcaaaggtattccgagccgtatgggtcttgtattggatatgtcaccgcgtgcgctggaagaagttatttactttgcttcttacgtcgtaactgacccggccaatacaccgctcgaaaagaaacagcttttatctgaaaaggaataccgtgcgtatctggataagtacggaaacaaattccaagcctctatgggtgcggaagccattaataaacttctgcaggacatcgaccttgtcaaagaagttgatatgttaaaagaagagctgaagacttctcaaggacagcgccgtacacgcgcgatcaaacgccttgaagtgcttgaagccttccgtaattcaggaaacaagccgtcttggatgattctcgacgtgcttccggttattccgcctgaattaagaccgatggttcagcttgacggcggacgtttcgcaacgtctgacctgaacgacctttaccgtcgtgtcatcaaccgtaataaccgtttaaaacgtctgttagacctcggcgcgccaagcatcatcgttcagaacgaaaaacgtatgcttcaggaagcagtcgacgctctgattgacaacggacgccgcggccgtccggttaccggaccgggtaaccgtccgcttaaatctctttctcacatgctgaaagggaaacaagggcgtttccgtcagaaccttctcggtaaacgtgtagactactcaggccgttccgttatcgtcgtaggtccgcatctgaaaatgtatcagtgcggtttgccgaaggaaatggcgcttgagctcttcaagcctttcgtcatgaaagagcttgttgaaaaaggccttgctcacaatatcaagagcgcaaaacgcaaaatcgaacgcgtgcagcctgaagtatgggatgtacttgaatctgtcattaaggagcatccggtcttactgaaccgtgcccctactcttcacagattaggtatccaggctttcgaaccgacgcttgttgaaggacgcgccatccgtcttcacccgttagtatgtacagcttataacgctgactttgacggtgaccaaatggcggttcacgtacctttatcagctgaggctcaagctgaggcgcgcattctgatgcttgcggcccaaaacatcttgaaccctaaagatggtaaaccggttgttacgccgtctcaggatatggtattaggaaactactacctgacgcttgagcgcgccggagcagtcggcgagggtatggttttcaaaaatacggacgaagcgcttcttgcttatcaaaacggttatgttcatcttcatacgagagtagctgttgcagcgaactcccttaagaatgtgacatttactgaagaacagcgttcaaaattgttaattacaactgtcggtaagctcgtcttcaatgaaattcttccggaatcattcccttacatgaatgaaccaacgaagagcaacattgaagagaagacacctgaccgtttcttcttagataaaggtgctgacgtaaaagctgtgattgctgagcagccgatcaacgcaccgtttaaaaaaggtattttgggtaaaatcatcgcggaaatctttaaacgattccatatcacggaaacgtctaaaatgcttgaccgcatgaaaaacctcggtttcagatattcaacgaaagccggcatcacagtaggggtttctgatatcgtcgttctcgatgataaacaggaaatccttgaagaagcacaaagcaaagtagataatgttctgaaacagttcagacgcggtttaatcaccgaagaagaacgttatgaaagagtcatttcaatttggagttcagcgaaagatgttatccaaggcaaactgatgaaatcattagacgaagtcaacccgatctacatgatgagtgattcaggagcccgtggtaacgcatctaactttacacagcttgcgggtatgcgcggtctgatggccaacccggctggacgaatcattgaattgccgattaaatcaagtttccgtgaaggtctgacagtattggagtactttatctccactcacggtgcgcgtaaaggtcttgccgataccgccctgaaaacagctgactcaggttaccttacacgccgtcttgttgatgttgcgcaggatgttatcattcgtgaaacagattgcggaacagaccgcggtattcttgcaaaaccgctcaaagaaggcacggaaatcatcgagcgtctggaagagcgtctgatcggacgtttcgccagaaaacagatcaaacatcctgaaacgggtgctgtgctcattaacgaaaatgaattgatcgatgaagataaagcgctggaaatcgttgaagccggaatcgaagaagtgtggatccgttctgcgttcacatgtaacactcctcatggtgtatgtaaacgatgctacggacgaaaccttgcaaccggaactgatgttgaagtcggcgaagcagtaggtattatcgccgctcaatctatcggtgagcctggaacacagttaacgatgcgtacgttccacacaggcggggttgccggagacgatatcacacaaggtcttccgcgtatccaggagcttttcgaagcgcgtaatccgaaaggtcaagcgacgatttctgagattgacggtacaattgccgaaatcaatgaagtccgcgacaaacagcaggagattgttgttcagggtgctgttgagacccgttcatacacggcaccttacaactcacgcctgaaagtgactgagggtgatcagattacccgcggtcaagtgctgacggaaggttcaatcgatccgaaagaacttcttaaagttactgacctgacaacggttcaggaatatcttctgcatgaggttcagaaggtttaccgtatgcagggggttgaaatcggcgataaacacgtagaagtaatggttcgccagatgcttcgcaaagtccgtgtaatcgatgccggagatactgatgttctccctggcacattgcttgatattcaccaatttacagaagcgaacaaaaaagtgctgcttgaaggcaatcgacctgctacaggccgtcctgtccttctcggtatcacgaaagcttcacttgagacggattcattcttgtctgccgcatcattccaggaaacaacacgcgttcttacagatgctgcgattaaaggcaagcgtgatgaacttctcggcctgaaagagaatgtcatcatcggtaaactggttccggccggtacaggtatgatgaattacagaaaagtaaaacctgtttcaaacgttcagccttcggaagatatggttccggctgaataacagaaactgctgcaggaaaggctgtttcgacagcttttcctcagtattacaattattctggcggggactgcactaaaaaatgtcatacgttgttgacatccgtcccgcagagtgataatataaccaaggtgctcgaaataaaacctgttactttggaggatatgtttatgtcttatgataaagtatcacaggccaaatcaattattattggtacgaagcaaacagtgaaagctctaaaacgaggttcagtgaaggaagtcgtcgtggcaaaagacgcggattcagttcttacggctggcgttatccagcttgcaaagaaccaaaataccgctgtctgtatggtggattccatgaaaaagctcggcaaagcctgcggaattgaagtgggagcagcagctgttgccattatgttatagcgtactttttgtttttatataagatatcaatcttatgtaaagacattgtttttttgcctaatgatgaaccacctgggtatgtgggttataaaacgtaatgaagggaggaacacaacatgcctacaattaatcagctaattcgcaagggacgcgtgagcaaagttgaaaactctaagtcacctgcactaaacaaaggatacaacagctttaaaaaagagcacactaacgtatcttctccacaaaaacgcggggtatgtactcgtgtcggtacaatgacaccgaaaaaaccgaactcagcacttcgtaaatatgctcgtgttcgtttgactaacggaatcgaggttactgcctacattcctggtatcggtcacaacctgcaagagcacagcgttgtactgatccgcggcggacgtgtaaaagacttaccgggggtacgctaccacatcgttcgtggcgcgcttgatactgccggagttgaaaaccgtgcgcaaggccgttctaaatacggtacgaaacgtcctaaagcaaagtaataataataaatcattaaaactatgaagggaggatattcagatgccacgtaaaggtcctgtagcaaaaagagatgttttacctgatccgctttacaactctaagctggtatcccgcctgatcaacaaaatgatgatcgacggtaaaaaaggtaaatctcaaacaatcctatacaagtcattcgatatcattaaagaacgcactggcaatgatgcaatggaggttttcgaacaagcattgaaaaacatcatgcctgtacttgaagtaaaagcacgccgtgtaggtggagctaactaccaagtgcctgtagaagttcgtcctgaacgccgtacaactcttggtcttcgctggttggttaactatgcgcgtcttcgcggagaaaaaacaatggaagagcgcctggctaacgaaattcttgatgcagctaacaacactggtgctgccgttaagaaacgtgaagacactcacaagatggcagaagcgaacaaagcatttgctcactaccgctggtaggattcatataatcaaaataataattccctaataaggaaggagaaattacccaatggcaagagagttctccttagaaaaaactcgtaatatcgggatcatggctcacatcgatgccggtaaaacgactactacagaacggatcttgttctacacaggccgtatccacaaaattggcgaaactcacgaaggtgcttcgcaaatggactggatggagcaggaacaagagcgcggtatcacaatcacttctgcagcaacgactgcacagtggaaaggttaccgtgtaaacatcatcgatacaccgggacacgtagacttcacagttgaagttgaacgttcactccgtgtacttgatggtgcggttgccgtacttgatgctcaatcaggtgttgagcctcagacagaaacagtatggcgccaagcaacaacttacggagtaccgcgcgttgtatttgtcaacaaaatggacaaaatcggcgcagacttcctttactctgtaggcactttaagagaccgtcttcaagctaacgctcacgcaattcaattgccgatcggcgctgaagacaacttcgaaggtatcatcgacttagtagaaaacgttgcgtatttctacgaagatgaccttggaactcgttcagatgcgaaagaaatccctgaagagtacaaagagcaagctgaagagcttcgcagcagcctgattgaagctgtagctgagcttgatgaagagcttatggaaaagtaccttgaaggtgaagaaatcactatccctgaactgaaagctgctatccgtaaaggtacactgaatgttgaattctaccctgtacttgttggttctgctttcaaaaacaaaggtgttcagcttgtacttgatgctgttcttgactaccttcctgcgccaactgatgttgctgcaatcaaaggtgttcgtcctgatacagatgaagagatcgttcgtcattcttctgatgaagagccgttctctgcacttgcatttaaagttatgactgacccttatgtcggtaagctgacattcttccgcgtatattccggtacacttgattccggttcatatgtaaagaactctacaaaaggcaagcgtgagcgcgtaggacgtatccttcaaatgcacgctaacagccgtgaagagatctctactgtttacgctggagacatcgcagctgctgtaggtctaaaagatacttctactggagatactctgtgtgatgaaaaggatcttgtaatccttgaatcaatggaattcccagagcctgttatcgacgtagcgattgagcctaaatcaaaagctgaccaagataaaatgggtatcgctttagcgaaacttgctgaagaagatcctacattccgtacacaaactaaccctgaaacgggtcaaacaatcatctctggtatgggtgagcttcaccttgatatcattgttgatcgtatgaagcgtgagttcaaagttgaagctaacgttggtgctcctcaagttgcgtaccgtgagacattccgtaccggtgcaaaagttgaaggtaaattcgtacgtcaatcaggcggacgcggtcagttcggtcacgtttggatcgaatttgaaccgaacgaagaaggcgctggctttgaattcgaaaacgcaatcgtcggtggtgttgttcctcgtgaatacatcccagccgtacaagcaggtcttgaagactctcttgaaaatggtgtcctagccggattcccgctaatcgacatcaaggcgaaactttttgatggatcttaccatgatgttgactcaaacgaaatggcgtttaaagtcgctgcttctatggcattgaaaaatgcagtcagcaaatgtaacccagttcttcttgaaccaatcatgaaagttgaagttgttattcctgaagaatacatgggagacatcatgggtgatgttacttctcgtcgcggacgcgtagaaggtatggaagctcgcggtaacgctcaagttgtgcgtgcgatggtacctcttgctgaaatgttcggttacgctactgcccttcgttctaacacgcaaggacgcggtacgttcacaatgttcatggatcactacgaagaagtgccgaagagcatcgctgaagaaattatcaaaaaaaataaaggcgaataattgattttgccacttaactcaagtataactactattgtaagatgaggaagtgagagcttgctttcactttctatcactctatacattactaattaaaagctcttaaggaggattttagaatggctaaagaaaaattcgaccgttccaaatcacatgccaatatcggtacaattggacacgttgaccatggtaaaacaacattaactgctgctatctcaacagtacttcataagaaatctggtaaaggtacagctatggcgtacgatcaaattgatggtgctccagaagaacgtgagcgcggtatcacaatctctactgcacacgttgagtacgaaactgacactcgtcactatgcacacgttgactgcccaggacacgctgactatgttaaaaacatgatcactggtgctgcgcaaatggacggagctatccttgtagtatctgctgctgatggcccaatgccacaaactcgtgagcacatccttctttctaaaaacgttggtgtaccatacatcgtagtattccttaacaaatgcgacatggtagacgacgaagagcttcttgagcttgttgaaatggaagttcgcgatcttcttagcgaatacgacttccctggtgatgatgtaccagttgttaaaggttctgctcttaaagctcttgaaggcgatgctgagtacgaagaaaaaattcttgaacttatggctgcagttgatgagtacatcccaactccagaacgcgacactgaaaaaccattcatgatgccagttgaggacgtattctcaatcactggtcgtggtacagttgctactggccgtgtagaacgcggacaagttaaagtcggtgacgaagttgaaatcatcggtcttcaagaagaaaacagcaaaacaactgttacaggtgttgaaatgttccgtaagcttcttgactacgctgaagctggagacaacatcggtgcacttcttcgcggtgtagctcgtgaagacatccaacgtggacaagtacttgctaaaccaggtacaatcactccacacagcaaattcaaagctgaagtttacgttctttctaaagaagagggtggacgtcatactccattcttctctaactaccgtcctcagttctacttccgtacaactgacgtaactggtatcatcaatcttccagaaggcgtagaaatggttatgcctggagataacactgaaatgatcgttgaacttatctctacaatcgctatcgaagaaggaactcgtttctctattcgtgaaggcggacgtacagttggttcaggcgttgtttctacaatcactgagtaatcgactcgttcaataatgcggggtcccttatggggcctcgtttttttgtttccctgctgattccatgtataatagaacgtatacaaattttaggagcagaccgatgaacgataacttcaagaaaaccaatcgtatttcaatgcttcagcaattgcagattaatggcagtgaacaaaccattatgattaatggtgatgacaggagtagtccgctgcttttgtttttgcatggcggtcccggcacgcctcaaatcggttatgcgagaaaataccagaatgagctggaaaagcatttcaccgttgtgaactgggatcagagaggggcgggtctctcttattcaaaggaaattccgggttcatctatgactttggatcagctgacagctgacaccattcatctgaccgaacgcttatgcaagcaattcagcaggagaaaaatatatatcgccggctattcgtggggttcagttttggcgcttcaagttcttcaagagaaacctgatttgtattatgcgtatatcggtatcagtcaggtggttaatattcaaaaggaagaaacggaagcctaccggttgatgatggaatggagcaggcaacacaaacatatcctgctgggcaagacgctgagctttatcggagcaccccatgggagaaacagctgcagcgaacgctgtttctgctttgtattgaaatgaggggagggggctttacccatcatccgatcggcgctcttaaagcaggggggcgaatgctgtttggtgaaccgtacggtgtgagagggagcttcttagccgcgcggggacaaatgttcagcctgaaacacctgtgggaggatctcatttcctttgatgcaggggaatcagtttcttctattgtaataccgtgctgttttatgtcagggagatacgatttgacggttccggggacgacgtcttatgaatattatcagaaggttgatgcgccgtataaagaatggcattggtttgagaactcagcccattcgcctcacttggaggaaccggatcgctttgccgaagttgtcagccggttcgcatcgttccatctctgaaagaaaacagtcatatccttgattaatcatggtatcacctgtataataatcaaagtgtgaaaaccacaaggttctttaaataaaccttgcaacatgcgtctattttctgtataatagtgtatgttggtctttgactgcgatgaagtgagaggttgctgacacacccggccgctttgccatggcaaggtgatcaggtttttctcacggagaactgtctaacgtgatgtaggcgaaaaggagggaaaataatggcaaaacaaaaaattcgtattcgtttaaaagcatatgatcatagaatccttgatcaatctgcagagaagattgttgaaacggcaaaacgttctggtgccagcgtatctggtccgattccgttgccgactgaaaaatcagtttacacaatccttcgtgcggtgcacaaatacaaagattctcgtgagcaatttgaaatgcgtacacataaacgtttaatcgacattgtgaacccaacaccacaaactgttgatgctctcatgcgattagacttaccatctggtgtcgatatcgaaatcaaactttaattctaaaatatagaatgatcttaataggaggtgtgacgaatgaccaaaggaatcttaggaagaaaaattggtatgacgcaagtattcgcagagaacggtgatcttatcccggtaactgttattgaagcagctccaaacgttgttcttcaaaagaaaacagctgaaaatgatggctatgaagcgatccagcttggttttgacgataagcgcgaaaagctttcaaacaaaccggaaaaaggacacgttgcaaaagcggaaactgctcctaagcgcttcgttaaagaattacgcggcgtggatatggatgcgtatgaaattggtcaggaagtcaaggttgaaattttctctgcaggagaaatcgtagatgtaacaggagtatctaaaggtaaaggtttccaaggtgcaatcaagcgccacggacaatctcgcggacctatgtctcacggttcacgctaccaccgtcgtcctggttcaatgggacctgtagatcctaaccgtgtattcaaaggtaaactattacctggacgcatgggcggagatcaaatcactgtccaaaaccttgaagtcgtaaaagtagatgctgagcgcaatcttcttttgattaaaggtaacgtacctggtgcgagaaaagctttaatcactgttaaaagtgctgttaaatctaaataagtctcttaggaaaggaggaaattgatcatgccaaaagtagcattatacaaccaaaacggttctactgctggtgatatcgaattaaacgcttctgtatttggaattgagccaaatgagagcgtagtattcgacgctattcttatgcaaagagcttccttacgtcaaggatctcacaaagtaaaaaatcgttctgaagtacgcggcggaggtcgcaaaccatggcgtcaaaaaggtacaggtcgtgcccgtcaaggttcaatccgttcaccgcaatggcgcggaggtggtgtcgtattcggcccaacaccacgcagctattcttacaaattacctaaaaaagttcgccgcttggcaatcaaatcagtattgtcttctaaagtgaacgacaacaacattattgttcttgaagatcttactcttgatacggttaaaacaaaagaaatggcagctgtccttaaaggattatctgttgagaaaaaagctttaatcgtaactgcggatgcaaacgaagcagtatctctttctgcacgcaacatccctggagttacagttgttcaagctaacggaatcaacgtgttagacgttgtcaaccacgagaagcttctgattacaaaagctgcggttgaaaaagtagaggaggtgcttgcataatgaaagatcctcgtgatgttcttaagcgccccgtcattactgaacgttctgctgatttaatgactgaaaagaaatatacttttgaagttgatgtaagagctaataaaacagaagtgaaagatgcagttgaaagtatctttggagtgaaagttgacaaagtcaacatcatgaactacaaagggaaatcaaaacgtgtcggccgctatactggtatgactagccgtcgcagaaaagcgatcgtaaaacttactgcagacagcaaagaaatcgaaatttttgaagcttaattatctgtaaaaagaaggagggaaattcaaaatggcgattaaaaagtataaaccgacctctaacggacgtcgtggcatgacaacttcagattttgctgaaatcacgactgaccagccggaaaaatccttgcttgcgccccttcacaaaaaaggcggacgtaacaaccaaggtaaattgactgtacgtcaccaaggtggcggacacaaacgccaataccgtgttatcgacttcaaacgcgataaagatggtatacctggacgcgttgctacagttgagtacgatccaaaccgttcagctaacattgcactaatcaactatgtagacggagaaaaacgttacattcttgctccaaaaggaattcaagtaggtactgaaatcatgtccggccctgaagctgacatcaaagtaggtaacgcacttccgcttatcaacatccctgttggtacagttgtgcataacattgaattaaaacctggtaaaggcggacagcttgtacgttcagctggtacatctgctcaggttcttggtaaagaaggcaaatacgttcttgtacgtcttaactctggtgaagttcgcatgatcctttctgcttgccgcgcttctatcggtcaagtaggtaacgagcagcacgaacttatcaacgttggtaaagcaggacgctctcgctggaaaggcatccgccctacagtccgcggttctgtaatgaaccctaacgatcacccgcacggtggtggtgaaggtcgcgcgccaatcggacgtaaatcaccaatgtctccttggggcaaaccgactcttggattcaagacacgtaagaaaaagaacaaatctgataaatttatcgtacgtcgtcgtaaaaataaataacggggttgtctacggttcatttcggaccgtagtgcaatcacgaagggaggttccaaaatggctcgcagcttgaaaaaaggaccatttgtcgatggacacttgatgacaaaaatcgagaaattaaatgaaacggacaagaaacaagttgtaaaaacttggtctcgccgttcaactattttcccacaatttatcggtcacactatcgcagtatatgacggacgtaaacacgtgcctgtattcatttctgaagacatggtaggccacaagttgggcgaattcgcaccgactcgtacttacaaaggccacgccagtgacgataaaaaaacaagacgctaagagaggaggcttttaaatgcaagctaaagctgttgcaagaacagtccgtattgctcctcgtaaagcacgtctagtaatggacctgattcgaggtaagcaagtaggcgaagcagtatctatcttgaacctaactccgagagctgcttctccgatcatcgaaaaagttttaaaatctgctatcgcaaatgctgagcacaactacgagatggacgctaacaatctggttatttctcaggcatttgttgacgaaggcccaacgttaaaaagattccgcccgcgtgctatgggacgtgcgagccaaatcaacaaacgtacgagccacattacaatcgttgtatcagaaaagaaggagggataagtagtgggtcaaaaggtaaatccagtcggtcttcgtatcggagtcattcgtgattgggaatctaagtggtacgctggtaaagattacgctgacttcctgcacgaagatttaaaaattcgtgaattcattagcaaacgcctttctgacgcttctgtttctaaagtagaaatcgagcgtgcagcaaaccgcgttaacattacgatccacactgctaagcctggtatggtaatcggtaaaggcggatctgaagttgaagcacttcgtaaagcccttaacagccttactggcaagcgtgtacacattaacattcttgaaatcaaaagagcagatcttgatgctcagcttgtagctgacaacatcgctcgtcaactagaaaaccgtatttctttccgccgtgcgcagaaacaacaaatccaacgcactatgcgtgctggagcacaaggtgtgaaaacaatggtttccggccgtcttggcggagctgatatcgctcgttctgaatactacagtgaaggaactgttccattgcacactttacgtgctgacatcgactatgcaacatctgaagctgacacaacttacggtaagcttggtgtaaaagtctggatctatcgtggagaggttcttcctactaagaagaaaactgaggaaggaggaaaataatatgttattaccaaaacgcgttaaatatcgcagagagcatcgcggaaaaatgcgcggtcgcgctaaaggcggtactgaagtacattttggtgagtacggtatccaggctcttgaagcttcttggatcacgaaccgccaaatcgaagctgcacgtattgcgatgactcgttacatgaaacgtggcggtaaagtttggattaaaattttcccttcaaaaccttacactgctaaaccgcttgaggtacggatgggttccggtaaaggggctcctgaaggctgggtagctgttgtaaaaccgggcaaagttttatttgaaatttctggtgtgtctgaagaggtagctcgtgaagctctccgtcttgcatctcacaaattgccaattaaaacgaagttcgtaaaacgtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaatactgctcgcattcgtgaagtgcgcaaagctatcgcgcgcatgaaaactgtgattcgtgaaagagaaattgctgccaacaaataatcactgaggggaggtcgtgagcatgagcgaacgtaaccaacgcaaagtttaccaaggccgtgttgtttctgacaaaatggataaaaccatcactgttgttgttgaaacatacaaaaaggatcctatttacggtaaacgcgtaaaatactcaaagaaattcaaagcacatgatgaaaataaccaagctaaaatcggagacatcgtaaagatcatggaaactcgtccattatctgcaactaagcgttttcgtctagtagaagttgtcgaagaagctgttattatctaataaagttcggaattctttttccgaagggaggtaacaaataatgattcaacaagagactcgtttaaaagttgctgacaactccggtgcgcgtgaggtacttactattaaagttcttggcggttctggacgtaaaacggctaacattggtgatgtaattgtttgcacggttaaacaagcaacaccaggaggcgttgtcaaaaaaggtgaagtcgtaagagctgttatcgttcgcacaaaaagcggagcacgcagatctgacggatcatacatcagcttcgatgagaatgcatgtgttatcatccgtgacgacaagagcccgcgtggaactcgtatcttcggaccggttgcccgtgaattacgtgaaaacaacttcatgaaaattgtttctctggctccagaagttatctaatgaaataaatgccttactcaaggaggtgcgatcaggatgcatgtgaaaaaaggcgataaagtaatggttatctctggtaaagataaaggcaaacaaggtacgatccttgctgctttccctaaaaaggaccgcgttctagttgagggcgtaaacatggtgaagaagcactctaaaccaactcaagcaaaccctcaaggcggtatttctaatcaagaggcgccaattcatgtatcaaacgttatgccgctcgatcctaaaactggtgaagtgactcgcgtaggatacaaagtggaagatggcaaaaaagttcgtgttgcaaaaaaatctgggcaagtcttagataaatagtatttaaaggaagggaggtctatctcatgaaccgccttaaagaaaagtacaataaagaaatttcacctgctttaatgacgaagttcaactacgactctgttatgcaggtgccaaaaatcgaaaaaatcgtaatcaacatgggtgtcggtgatgctgttcaaaacgcaaaagcaatcgacagtgctgttgaagaattaacgtttatcgcaggtcaaaaacctgtcgttactcgtgcgaagaaatcaattgctggattccgtcttcgtgagggaatgcctatcggtgcgaaagtaactcttcgcggagagcgcatgtatgatttccttgataaacttatttctgtatctttaccgcgtgtacgtgacttccgcgggatttctaagaaatctttcgacggtcgcggaaactacactcttggtatcaaagaacagttaatcttccctgaaattgactacgataaagtaacaaaggttcgcggaatggacatcgttatcgtaacgactgctaactctgacgaagaggctcgtgagctattaactcaagtaggtatgccgttccagaaataatcaatgaaagggaggcgaaatcgtggctaaaaagtcaatgattgcgaaacaacaacgtacaccaaagtttaaagtgcaagagtacactcgctgtgaacgctgcggacgtccgcactcagtcattcgtaaatttaaactttgccgtatttgtttccgtgagcttgcatataaaggacaaattcctggcgtgaaaaaagccagctggtaatccccaagaatgggaaggaggtaattatataatggttatgacagatccaattgcagatatgctgactcgtattcgcaatgcaaacatggtacgtcatgagaagcttgaaattcctgcttctaaattgaaaagagaaattgctgacattttaaagcgtgaaggtttcattcgtgacgttgagttcgtagaagacagcaaacaaggtatcatccgcgttttcttgaaatacggacaaaacaacgagcgcgttatcactggtcttaaaagaatcagcaaaccaggtttgcgtgtatacgctaaatcaaatgaagtacctcgcgtacttaacggtcttggaatcgcgattatttctacatcacaaggtgttttaacggacaaagaagcccgtgcaaaacaagctggtggagaagttctagcatacgtttggtaagaagtttaacaagaatggaggtgttttagtatgtctcgtgtaggtaaaaaactgcttgagatcccttctggagttacagtaacgctgaacgaaggcaacactgtagctgtaaaaggaccaaaaggagaattaactcgtactttccatcctgatatggaaatcaaaattgaggacaacgtgcttacagttactcgtccttctgatcacaaagagcaccgtgcgctgcatggtacgactcgcagtctgcttggaaacatggttgaaggcgtatctaaaggatttgaaagaggtttggaattagtcggtgtcggttatcgtgcggctaaatccggaaacaaacttgttttaaacgttggatactctcaccctgttgagatcgttcctgaagagggcatcgaaatcgaagttccttctcaaactaaagtagttgtaaaaggtacagacaaagagcgtgtaggagctatcgctgctaacatccgcgctgtacgttctccagagccttacaaaggtaaaggaatccgctacgaaggtgaagttgttcgccgtaaagaaggtaaatctgctaagtaagaccgcttaaagtgaagaaaggagtgacctaaggatgattacgaaaactagcaaaaatgctgctcgtcaaaaaagacatgcccgtgttcgtgctaaactttcaggcacagctgaaagacctcgtctgaatgtgttccgttcaaacaaacacatttatgctcaaatcatcgatgatgtaaatggcgttacacttgctagtgcctctactcttgataaagatttgaacgtggaaagcactggtgacagcgctgctgctgctaaagtcggtgaactcgttgcgaaacgcgcttctgagaaaggtgtttctgacgtagtatttgaccgcggcggatacttataccatggacgtgtaaaagctctggccgatgcagctcgtgaagccggactgaaattttaataaaaaaaggagggacacatgattatgcgtcgtattgacccaagcaaattagagttagaagaacgcttagttacggttaaccgcgtagcgaaagttgttaaaggtggtcgtcgtttccgtttcgcagctctagtcgttgtcggtgacaaaaacggtcacgtaggtttcggtactggtaaagcacaagaagtacctgaagcaatccgcaaagctgttgaagatgcgaaaaagaatttgattgaagtaccaatggttggaactacgattccacacgaaatcatcggacgtttcggtgcaggcaatatcttgttgaaacctgcttctgaaggtactggagttatcgctggaggccctgtacgtgcggtacttgagcttgctggcgttgctgatatcctttctaagtctttaggttctaacacaccgatcaacatgatccgtgcaacacttcaaggtttaagtgagcttaaacgtgccgaagaggttgcgaagcttcgtggaaaatctgtagaagaactgttaggataaggagggaacattaatggctaaattagaaattaccctcaaacgcagtgtaatcggtcgcccggaagatcagcgcgttactgtaagaacacttggtttaaagaaaacaaaccaaactgtcgttcatgaagataacgctgcgatccgcggtatgattaataaagtatctcatctagtttctgttaaagaacaataaaaataaattataggctaaggaggtgtcctaatgaaacttcatgaattaaagccttcagaaggttcacgtaaagtacgcaatcgcgtaggtcgtggtattggttctggtaacggtaaaacagctggtaaaggtcacaaaggtcaaaacgctcgttctggcggcggtgtacgccctggattcgaggggggacaaatgcctttattccaacgtcttcctaagcgcggttttacaaacatcaaccgtaaggaatacgctattgtgaacgtagacaaattgaacggttttgcggaaggaacggaagtcactcctgaacttcttcttgagactggtgttattagcaaacttaatgcaggagtaaagattcttggcaacggtaaattagagaaaaaattaactgtaaaagccaataaattctctgcttctgcgaaagaagctgttgaagctgctggcggtacagctgaggtgatctaacttgtttaagacaatctccaactttatgcgtgtgagtgatattcggaataaaatcatttttacattactcatgcttatcgtctttcgcataggtgcgtttatccctgtgccatatgtaaatgctcaggcgttgcagacacaaagttcgatgggggtttttgatctccttaacacatttggcggcggtgcgctttatcagttctccatttttgcgatgggaattacgccttacatcactgcttcgatcatcattcagctgcttcagatggatgttgtgccgaagtttaccgagtggtctaagcaaggtgaagtcggccgccgtaaattagctcagttcacgagatattttacgattgtgcttggttttatccaggcattaggtatgtcttacgggtttaacaacctggcaaacggtatgctgattgaaaaatccggcatatcgacatatctgattattgctttagtactcactggaggaactgcttttttaatgtggctgggagaacaaattacttccaatggagtaggtaacggaatttcgatcatcatcttcgcggggattgtggctagtattccgaaaactgttgggcagatttatgagactcaatttgtcggcagcagcgatcagctgtttattcatattgtgaaaatcgctttactggtgattgcgattttagccgttattgttggtgttattttcattcagcaggctgtacgcaaaatcgcgattcaatatgcaaaagggcaaggtcgttcacctgttggcggaggccagtcaactcaccttccgcttaaagtgaatccggcaggggttattccggtaatctttgcggttgcgttccttattacgccgcgtactatcgcgtcatttttcggagaaaacgatgtgacaaagtggattcaagccaactttgacaatacacatccggtgggcatgacggtttatgtcgcattaattatcgcctttacgtacttctatgcttttgtgcaggtaaaccctgaacaaatggctgataacctaaaaaaacagggtggctatatcccgggggttcgtccagggaaaatgactcaagatagaattacgagcattttgtatcgacttacgtttgtgggttctatattcttagccgtgatttccattcttcctatctttttcattcaattcgctggattgcctcaaagtgcacagattggcggaacatcattgttaattgtcgtcggggtagccttggagacaatgaagcagctggagagccagttagtgaaacgtaattaccgaggatttatgaaaaattagaggactggttttaaccattcctctaaataagagaggacgggggaaatccgaatgaacttagtcttaatgggacttcctggagccggtaaaggcacacagggagaacgaattgttgaggattatgggatacctcatatctcaacgggagatatgttccgtgctgctatgaaagaagaaacaccactcggactcgaagcaaagtcttatattgataaaggcgagctcgtaccggacgaagtcacaatcggcattgtcaaagaaagactcggcaaagatgattgtgaaagaggttttcttctggacggatttccgcgaacagtcgctcaggctgaagctcttgaaaacattcttgaggaatacggcaagccgattgattatgtcattaacattaaagtagacaaagactctttaatggaacgtttgactggacgcagaatttgcagtgtttgcggcacaacctatcatttggttttcaatccgccgaaaacgccgggtgtttgtgataaagacggaggagacctttatcaacgggcagatgataatgaggaaaccgtctcaaaacggcttgaggtcaacatgaagcagactcagcctttactcgatttttattctgagaaagggtatcttgtcaacgtcaatggccagcaggacattaacgacgtgtacaaagatgtgaaagagcttcttggaggattgagcaaatgattatctgtaagacccctcgtgagcttagcatcatgcgggaagcagggcgaatcgtggctttgactcatgaagagatgaaaaagcacattaaaccaggaatctcgacaaaagaattggatcaaattgccgaacgttttattgagaagcagggtgcaatcccatcttttaaggggtataatgggtttcgcgggagcatctgtgtatcagttaatgaagaactcgttcacggaattcccggtaaaagggttttgcgtgacggtgacattatcagcattgatatcggtgctaaattaaatggttatcatggtgactctgcttggacatatccggtaggaaacatcagtgatgatgataaacgactgctggaagtgacagaggagtctttatataaaggcttgaaggaagcaaaaccaggtgaacgtttgtcgaatatttcccacgcaatacaaacgtatgtcgaaaatgagcagttttcagttgttagggagtatgtcggacatggtgttggtcaagacttgcatgaggatccgcaaattcctcattacggtccgccaaacaaaggacctaggctgaagcctggtatggttctcgctatagaaccgatggttaacgctggcagccggtatgtgaaaacattggctgataactggacggttgtaacggtagatgggaaaaagtgtgctcattttgaacatacgattgcgattacggaaacgggttttgatatactgacaaaagtctagatgatgaaatgaattccatgacacatgtttttcattccgcacctgggcagattgtaggtttacaattggtcggaagaaaaaccggctagctgctgtcatcggaaggaagattcatcatcgtgtactaaagcagacggagaaaagcgtacatttcattctccttagaaaaagaatatcaatcattcaccctttatgattgcgtatctccggaagttcagaacagtataaacgaaacagggcgtgtgacaaacggataactgagattttctcttttgaaatttgtcagagagcaagttactgatttgaagaagggagaacacttgaatggcgaaagacgatgtaattgaagtggaaggtacgattgtcgaaacactgccaaacgcgatgttcaaagttgaactcgaaaatggccatacggttttggctcacgtatctggtaaaatccgcatgcacttcattcgcattttacctggagacaaagttacggtagaattatctccatatgacttaactcgtggcaggattacgtaccgttacaaataaagcactccggaaactgaaggaggttggaaacacatgaaagtgagaccatcagttaaaccaatctgcgagaaatgtaaagttattcgcagaaaaggaaaagtaatggtgatctgtgaaaatccaaagcataaacaaaaacaaggataattaataaggaggtgcccagagaatggctcgtattgctggtgtagatatcccacgtgacaaacgtgttgttatttctttaacatatgtcttcggaattggccgcacaacggctcagcaagtcttgaaagaggctggtgtttctgaagatactcgtgtgcgtgatcttactgaagaagaacttggtaaaatccgtgatgttattgacaaactgaaagtagaaggtgaccttcgccgtgaagtttctcttaacatcaagcgtctgatcgaaatcggaagctaccgcggaatccgccatcgcagaggtttgcctgttcgcggacaaaactctaaaaacaatgcgcgtactcgtaaaggtccgcgtcgtactgtagctaacaagaaaaaataagtaagggaggtacctaaacaatggctgctgctcgtaaacaaaacacgcgtaaacgtcgcgtgaaaaagaatattgagtcaggaatcgctcatattcgttcaactttcaacaacacgatcgttacgatcactgatactcatggtaatgctatttcttggtcaagtgccggagctctaggattcagaggttctcgtaaatcgactccttttgctgcgcaaatggctgctgaaacagctgctaaaggttcaatcgaacacggacttaaaactcttgaagtaactgttaaaggaccaggttctggccgtgaagctgcaatccgtgctttacaagctgccggacttgaagttacagctatcagagacgtaactcctgttcctcataatggatgccgtccaccaaaacgtcgccgcgtgtaatttgtttgtatagattttgtgtccctgtcaataatgggttatgatacagttatttatgaaacgaatgcaccgactcgttgcctgagcacatacgggactaaacaatggggaatttcggatggaatctcatatgattctattcgaggtttcgacgttttgaaggagggttttaagtaatgatcgagattgaaaaaccaaaaatcgaaacggttgaaatcagcgacgatgccaaatttggtaagtttgtcgtagagccgcttgagcgtggatatggtacaactctgggtaactccttacgtcgtatcctcttatcctcactccctggtgccgctgtaacatcgatccagatagatggtgtactgcacgaattctcgacaatcgaaggcgttgtggaagatgttacaacgataatcttgcacattaaaaagcttgcattgaaaatctactctgatgaagagaagacgcttgaaattgatgtacagggcgaaggaactgtcacagcagctgatattacacacgacagcgatgttgaaatccttaatccggatcttcatatcgcgactcttggtgagaatgcgagtttccgagttcgccttactgcacaaagaggacgtgggtatacacctgctgattcgaacaaaagagacgatcagccaatcggcgtgattccgatcgattcaatctttacgccagtttctcgtttatcttatcaggtagaaaacactcgtgtaggccaggttgcaaactatgacaaacttacacttgatgtttggactgacggaagcactggaccgaaggaagcaattgctctcggttcaaagattttaactgaacaccttaatatattcgtcggtttaactgacgaagctcagcatgctgaaatcatggttgaaaaagaagaggatcaaaaagaaaaagttcttgaaatgacgattgaggaacttgatctttctgtccgttcttacaactgcttgaagcgtgcgggcattaacacggttcaagaacttgcgaacaagacggaagaagatatgatgaaagttcgcaacctgggacgcaaatcacttgaagaagtgaaagcgaaacttgaagaacttggactcggccttcgcaaagacgattgatctagtttccatgtgaactaggattttcgtgtgttttttaattagaaacagcattccattaaaggaggggacatcacatgtcatacagaaaactaggacgtacgagttcacagcgtaaagctatgcttcgtgatcttacaacagatttgatcatcaacgaaagaattgaaacaactgaaacacgtgcgaaagaacttcgctctgttgttgaaaagatgatcactcttggtaagcgcggtgacttgcatgctcgtcgtcaagctgctgcatacattcgcaacgaggttgctaatgaagaaaataaccaagatgcacttcaaaaattattctctgacattgcaactcgttacgaggagcgccaaggcggatacacacgtattatgaagcttggtcctcgccgtggtgacggtgcaccaatggcaatcatcgaattggtttaatcacatatttttgtgtatctaaagaagggcgggacagtttctaactggatctatgccctttttttagatatcagaactttttatcatgagacagaaaagcagagctatagctgagaggaggtcaggcgcccgtggatcaaaaacagcttatatccgtaaaagacattctattccgctaccgcaaagatgcagtaagaccggcgctggacggtgtgagtctggaggtatatgaaggagaatggcttgctatcgtaggtcacaacggttcagggaagtcgactttggccagagcgctgaacgggctgattttgcctgaggccggagaaattgaagtcggcggcatcaagctgactgaggataccgtgtgggatgtgcgaaaaaaaatagggatggtctttcagaatcccgataaccaatttgtcggaacgactgttcgcgatgatgtggcttttggtttagaaaacaatggtgttccgcgcgaagaaatgattgagagagtagattgggctgtcacacaagtcaatatgcaggattttcttgatcaagagccgcaccatctctccggaggtcaaaaacaaagagtggcgatcgcgggaattattgccgcgcgtcctgatattatgattttggatgaagcgacatccatgcttgacccgattgggagagaagaagtccttgatactgtcagacgcttaaaagatcagggcatggccaccgtcatttcgataacacatgacctggaagaagccgcaagggcggataggatcattgtgatgaacggcggcaggaaatatgcagagggcacgcctgaagagatttttaaattaaatgaagacttggttcgcatcggtcttgatttgcctttctcattccagctcagcctgcttttgaaagaaagcggactggcgttaacgaaaaaccatctgactcaggaagggctggtgaatgagctgtggacattaaaatcaaagatgtagaacaccgctatcaaatgaagacaccgtttgaacggcttgctctgtatgatatcaatgccgtgataaaagagggcagctacgttgccgtcatcggacatacagggtcgggcaaatcgacgctcctgcagcatttaaacggtttgctgaaaccgactaaaggacagcttgagctcgggagcacgattctggcagccggtaaaaagaataaagaccttaagactctgcgaaaaaaagtcggaatcgttttccaatttcccgaacatcagctgtttgaagagactgtgctgaaggacatcgcattcggaccgatgaatttcggtgtaaaaaaagaagacgctgaacggaaagcaaaagaaatgctggggcttgtgggccttccggaagacattttggatcgttcaccgtttgagctcagcggcggccagatgcgcagagtggcgattgccggcgttctcgcgatggagccggaagtgctggttttggatgaaccgacagccggtcttgatccgagagggcgccaggacattatggacatgttctatgcgcttcatcagcggggaaacctgactaccgttctcgtcacccacagcatggaggacgccgcccgctatgctgacgaaatgatcgtcatgcacaaaggcaccattaaagcgacggggagtccgcgtgacttgtttgtaaaaggtgaagagatggccgaaatgggactggatcttcctgagtcggtgaagtttcagagacggcttgaggaggctctcggagttaagtatgaaaaacccatgctgaccctgcaggatgccgcgagcgaaattaaggctttctttcaggaggaaaaggaccaatgatggacagcatgattatcggaaagtatgttcccggatcatcgcttattcaccgattggacccgcgaacaaaacttgtcagcatctttctttttgtatgtatcgtttttttggcaaacaacgtacaaacgtatgctttgctcggtttgtttacattcggggtgatcgccttaacacgagtgccgttcagctttttgctgaaagggcttaagccgattatctggattgtggcgtttacctttttattacacattttcatgacgcatgaaggatctgtcatttttcagcttggctggtttaaagtgtatgagggcggacttatacaggggatttttatctccctccgtttcgtttaccttatctttatgacaacgctgctgacgctgacaacaacgccgattgaaatcacggatggaatggagcagctcttgaatccttttaaaaaggtgaagctgcccgtacacgaactcgcattgatgatgtcgatatcattgcgatttatcccgacattgatggaagagacagataaaatcatgaaggcgcaaatggcgaggggtgcggactttacaagcggcccggtgaaagacagaatcaaagcggttgttccgctgcttgtcccgctgtttgtcagcgcctttaaacgcgcggaagagcttgcggtcgccatggaggcgagaggctaccagggcggtgaggggagaacgaaatacagaaagctcgtctggaccggaaaggataccggagccattctgctcatcatcgtattagccgtgttattgtttttcttaagaagttagaggtgctgctgaatgagagtgaaatgtaccattgcttatgacgggcatttatttaacggatatcaggttcagcctggaaagcggaccgttcaaagtgaattggaaaaagcgctggccgtcatccataaaacggacggcagggtgcctgtcatctcatcgggccgcacggacagcgatgttcatgctgccgggcaggttattcattttgatacgccgctgtccatcccggctgagaaatggccgtttgcgctcaatgccctgctgcctgatgatattgccgtcaaaacagcagagattgcggatgatgggttccatgcacgatttagcgcagtccaaaaggaatatcgctactttgtatatacggagaaacacccggacgtatttaaacgacattacgcttaccattttgcatatcagcttaatgtgcagaaaatgagggaagcttcaaggcacctcatcgggacacatgatttcacaagcttttgcgcggctgataccgcggttcaggataaggtcagaacgatttacgagctggattggactgagaccggagacggcctgcagatgcggatcaccggaaacggttttctctataatatggtcagaatcattgccggaacgttattggatacaggagctggaaaattttctcccgatgatgtaaaagcaatgctcgaagcgaaggatcgcgaagccgcggggcgcaccgcaccggggcacgggctgtatttatggagcgtttgctatgacaactaaaccaggtgtaacattttcttgacagagtctgcataaagttataagatatcatatggtatgtatttcaaccccacgataagccccggaacttattgtgttgtgaaatagaacgtaacagaagtttatgaaaaaatgacagatcatttaggagggaattaaatgcgtacaacacctatggctaacgcaagtactattgaacgcaagtggttagttgttgatgcagcaggcaagactttaggacgtctttctacagaagttgcatctatccttcgcgggaaacacaaaccgacttacacaccgcacgttgatactggagatcatgtgatcatcatcaacgctgaaaaaatcgagttaactggtaaaaagttaactgataaaatctactaccgtcacacaatgcacccaggcggtctgaaatcaagaacagctcttgaaatgcgtacaaactaccctgagaaaatgcttgagcttgctatcaaaggcatgcttccaaaaggttctctaggtcgtcaaatgttcaagaaattgaacgtataccgtggttctgagcatccacatgaagcacaaaaacctgaagtttacgaacttcgcggttaattaaaaaggaggttaccaatttggcacaggttcaatattacggtactggccgtcgtaaaagttctgtagcgcgtgtgcgcttagttccaggagaaggtcgtatcgtcgttaataatcgtgaaatcagcgagcacattccatctccggctctaatcgaagatatcaaacaaccattaactttaactgaaacagctggtacttatgatgttttagtaaacgtacatggaggcggcttatctggtcaagctggagcaatccgtcacggtatcgctcgtgctttgcttgaagcagatccagaataccgcgcaacacttaaacgtgctggtcttctgactcgtgacgcccgtatgaaagaacgtaaaaaatacggtcttaaaggcgctcgtcgtgcacctcagttctcaaaacgttaatcgttttggatggcaaaaaccacaacttcttggttgtggtttttttgtatttttttctcatatcgaagaggttatccgatgtttttctagaattgtttgttatactctattcattaccaataaggagcgcagttataatgaataagttagtcatacataacagcaaggcatgggataaaaaagtcgaaacaggcaatgaatggacggttgcggttgattctcatacaattggtgaagcgaaaaaaggcaattggagcatcagaatgacccccggaaaagatgtgccggcggattggtttccgcccatagacggtctggaggttctttgtctcgcttcaggaggaggacagcaagggccggtccttgctgctgcaggagcggacgtcaccatctttgacaattcggaaaaacagcttgcgcaagacagaatggttgcccagcgggacggtcttacgcttcggactgtcaaaggcagcatgaatgatctgagctgttttgatgatgagacatttgattttatcgtgcacccggtatcgaattgctttgttgatacggttcttccggtatggaaagaagcttatcgcgtattgaaaaaaggcgggtctttagtctccggttttgtaaatcccgtcgtgttcttatttgatatggatttagagcaggaaggcgtactaaaagtaaagtattccattccgttttcggatgaaaaagatctgagtaagaaaaaggtaaaggaacttattgataatcatgaagcgcttgaattcggccatacgctggaggatcaaattaaaggtcagattgacgcaggctttatggttgccggtttttacgaggacaaaggcggcctcgtgctggatgaatacattaatacatactccgtaacaagaagcattaaaatataaaaacggcatcccgtcagaggtgctgtttttttgcggctttttcctgcggacggctgatcacattagccgaaaccggttctattccaatctctctggcccaaaccgacagttgtcccatgtggtgaatctcatgcgcaaggatgtggcggagaatatcttctttaggaaaggtttggtccatccagtccggcttaacaagatccgcccctttgcgggagaccgcatgaatgacatcctcccgatactgttcagacagctttctgagatcctgaatgctcgtatagtcagactcagcgggtaaaacatcatctttacctaaaatggcacgagcccagctgatctcgacatcaatgatatgaaataaagtccgcaagatgctctccattccgcccgtccgggttttcgtcagttcctcccggctcagcttttcacatatcataaaccactcgtcacgcaccgtccaattgtattgaaacagctttttcatcacgtcacctcagctctttattcttccagttaacatgaaactccttcatttgggaggatttccactatcaacaaagcatgctttttcccttttcctttcaaaataacagtaaaaaggagcgtggctggcaatggcagaagtattatctttttcagacgtgaaacggcagaaggattatgagcttgagaagagtttactaaaggagctgtcactgacgcagatcattcagtccgtaaaagcatgtctcacccctttgtttccctttcttcaagacgaaaacggcattctgagtgaaggatgcatagattttgcaattgaagcgtatttattaggcggccggttcggcgtctttggattttatggtgagtctttgcagagggcgaacgcccgttcggctgaagaagaggaagaactgacggccgatttttttgaatatctttgcaattggacgcatgagcaatattcttccgttgaacaaaaagaaatctatgaagcgtcctgccggtttatcaacagctggtggacggaaggatttctgcaaagagaaaaacaatgtaagctccgcatgaggtaatcataatttcttcccttgtcccatacttattaataacggggacaagcgggagggaaagctatgacaaaaaagctgaaatggctcggttttttacttggctttatcatattattgtgtttattccggtttcaattccataatgatgattcatggcggccgtggagcctgccgctgagcgggaaaatcatctatctcgatccgggacacggcgggccggacggaggcgccacgggaggcagtcaccttgaaaaggacattactctcgaagtggcctccagggtcagagactatttgcaggagcagggagctttggtcattatgacgcgggagacggatactgatttagctcctgaagggacgaaaggctacagcagacgcaaagcggaagatctgagaaagcgcgtggagatcatcaaccgttcagaggcggagctttatatcagcattcatctgaacgccataccgtcaccgagatggagcggcgcccaaagcttctactatggaaaatacgaagagaatgaaaaagtggcaaaatatatacaggacgaattgagaatcaatttggagaatacaacgagaaaggcgaaacggatacacggcatttacttaatgcagaatgtaaccaaaccgggcgccctggtggaaatcggatttctgtccaatcccgcggaagcgaaaaggcttggccagcctaaatatcaggacaaaatcgcttcttccgtgtataagggcgtgttgagatattttacagaaaaaggagaccctcccgagtaaggagggtttttcgccgattctacgtttaatatatggtataataccatttgtaaacgaatacacaaagggtgagggttcgatgataagagaagatgaagtaagaaatatagtcggaaacatgcgcgaaccttttcttcatagaccgctgggagaattggatgccattaaagaagtaaaggtcaagccggaaaaacggcatgtcagtgtaaaaattgcattggcaaaaacggggacggctgaacagatgggcattcagcaggaaatcgtatccgttctgaaagaagcgggtgcggaaactgtgggacttcggtttgaagagctgccggaagaaacattggcgaaattcagccggcctgctgctgaaagcgaaaccctgctgaataggaaacatccgccggtctttcttgcggtggcaagcggaaaaggcggtgtcggcaaatcaacggtttccgtcaacctggccatttctcttgcgcggctcggaaaaaaagtcggcttgatcgacgcggatatatacggattcagcgtgccggacatgatgggtattacagttcgcccgacagttgaaggagaaaaactgcttcctgtcgaaagatttggagtaaaggttatgtcgatgggctttttcgtcgaagaaaacgctccggttgtgtggagagggccgatgctgggcaagatgctgaataacttcttccatgaggttgactggggagaggttgactatatcgttctcgacctgccgcccggcacgggtgatgtggcgctcgatgtacacacgatgcttccgagctgcaaagagattatcgtatcaacgccgcaccctacagccgcatttgtagcggcgagagcgggatctatggcgattaagaccgatcatgaagttgtaggggtcattgaaaatatggcttattatgaaagtgcaaaaaccggcgagagagaatatgtgttcggtcaaggcgggggagataagcttgcagaggaattgcaggtgccgctgcttggcagaattcctttaaaacagcctgattgggacaaggaccagtttgcgccttctgtctatgacagaagtcatccgatcggggaaatttatatgggtatcgcccaaaaagtcattgaaaaaacagctgaataaaaaaggggccgggatcaacacggcccggccttttattggctttctttttcagaacttgaagccgcttttttcaattcatcctcgaattgctttttgaaaagcgggctggaaagtgtctctgtaattacatcttctaagtaactgcggaacttttggcttttcaccagctcatagtattttttatccatgccggggtcctgcatgatctgcataaaacttttctgataatcagggtctttcatcaatttttttatgattttttcgtgctcgggctgaagcgtttttgcaaagctctcggcgaactttgagtcttcaaagatggttttccagaactccgccccttttttagaggtgagggttttctctattgtgcctttaatggcattttgatcaatcaccaatgcctcattcatcgcatcatcatttaatatttccttaattgctttttttccatcatctgtctttaatatatcaacaaccatttttttagtctggtcataatccatatccgctgcttggtcttttggagcacaagctgttacagataatacaacaaaacagcttatcaatagcgttttggcttttgacatgcataagctccttccttacttgtacttatttttaatatgattcatcggaatggatttatacataacaaaatatcgctgaacgcgattgtcaggggatgaataagagatgaaaagccgcgggcttgttcgatttttcttttcgattttagctgtgggcgctcttattacaagcgtcgtgggatttgcactgaagtggggggagtacaaggggttctttctgaattttgaggccggtcaaattttctccgttctgatctggtttatcggggtaggcatgattttcagtgtgatcagccagatgggattcttcgtctttctgacggtgcaccggtttgcccttgaaatcctcagatcaaactcgctttggaatctgcttcagctgtttatcattctgtttgtcgcttttgatttaatgtacgtcagatttttgtttttcggtgagcgggatgactcgattgcggggtttgtctggctgccgctggctctgcttgccgtcggcttgctgacggcgtatataaaacaaaagcagtcctcaaaaaatacgttcgtttcatcattatttttaatggtcgttattacagcgcttgaatgggttcctgcgctaagagtgaataatgaggactggctttatttgatgctgattccgctgatgggctgcaatgcgtttcagctgttaatgctgccgaagtttgcccagaggtagttatttcacttctgatgacttgacgtcagtatttgcgatcaggtcgccgactgtcacgtttttcagtcctttttgctttaaattgtgaatgatggcggggagcgcttcttcggtctgtgttgctgaatcagaggcgtgcagcaggacaatgtcgccgccttttatatgactgtttacattttcaatgattttatcaggaccgggatttgtccaatcctgcgagttaacgctgtaatgaaccactgaatagcggtactgctgtgcaatggcaagaacctttttattaaattgtccggtcggcgggcggagtaaatgaacattcttcacacccagctttttaaatgcggtctgggcccgaaggatatctttttttatttcgttgtcctctaggttggtataattcttatacgcatatcccatgctgccgatttgatgtccgtcttttaccatacgttcaactgtgtccgggtgccgttccgcccaagaagctgacagaaaaaaagtggcgtttttaataccgtttgcttttagcgcgttcagaatcggaaccgctttttcatcgccccagctgatatcgaatgttaatgcgacttcgcccgctttcgtctccccttttgaaatagccttcgggccgctatcagttaaaaatacaggaagggggacggctctctgtatataaaaaaagctggctgctgcaaatgcggcaatgataataataagcagctgttttatccttctgatgtgccacacgtagaagtggttcactggtgacgcctccttatcttgtccatgcttgattacatcgtatgccgcggcggagatgaatataacgaaatacgtttcaaaaaaaaacgaaaaaaatacttgctaaattcagccgatgcatggtatattattaaacgtcgctgatggacagcagacaacaacaaaaagcttcggaaacaacttaaaaaaagttgttgacataaaagaagctgagtggtaagataataaagctgcttcaacaagcggtaatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagacctcgggtcttataaacagaacgttccctgtcttgtttagttttgaaggatcattcgattcttcgagatgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagacccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctttttattttatctaccatgtttttgtttatgaagcttataatattccgcagtagctcagtggtagagctatcggctgttaaccgatcggtcgtaggttcgagtcctacctgcggagccattgcttccatagctcagcaggtagagcacttccatggtaaggaagaggtcagcggttcgagcccgcttggaagcttatctaaaatacgttgatctgaagcagtttccgaatgttatggaactgttattttttgtttagttcagtaaaaacctgttgctgattgtaccagttaaggtgtaggtatttagcgcgtctcctgatgaagcctttcttcaaggatgcaaaagagattaacataattaattgttaaacgatattgacttttatcaaaaccttgatataattacttttgtcataatgaacagtataaataacaatacggtttaccgctatctgaagctgtattctggccatgtattacacttttacttgcggaagtagttcagtggtagaacatcaccttgccaaggtgggggtcgcgggttcgaatcccgtcttccgctccattttatcccaacgggatattgtgaaattgattgcgcccgtagctcaattggatagagcgtttgactacggatcaaaaggttaggggttcgactcctctcgggcgcgccataatattttttaaaatcgggaagtagctcagcttggtagagcacatggtttgggaccatggggtcgcaggttcgaatcctgtcttcccgaccattctcaagctttaaagataatatactggttttctttttttctctttttaaaaaaaatgcttgatttatagagaagcaccgtggtatattattaaacgtcgctgatggacagcagacaacaacaaaaagcttcggaaacaacttaaaaaaagttgttgacataaaagaagctgagtggtaagataataaagctgcttcaacaagcggtaatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaaggattttaacggaatataagacctcgggtcttataaacagaacgttccctgtcttgtttagttttgaaggatcattcgattcttcgagatgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcgggggtttccccctgtgagagtaggacgccgccaagctgtcttaaaccagttcatgatgaactggtttttttatttgaaagatcacatagatatataaagctaatgcctttcaaaggcattagcttttttgtttacattgattttgctttgctgttgtgattttgaagattgtttgattttattgtctcgagtattcttaaactgaacacaatcagcagcataaggaccatcagtgcagtaaacagccagaacgcagtttgtgcgggatattcatctaagctccagccgacggcgatcggaaggagtgaacctcctaatccgtttgaagcgagcagaatactggtagtcgtttctgtctttccgggataaaaatgattcgtgatgattagggctattgcaaacatgcctgccatgaacagccctaaaaagaagcaaagggcaaagccgaaccatacgtttttacttagtgctaatacggtaagtgctgccagaccgccaatgcttatgagacgaagataacggtgatatgtcagcttttctgataccgggcctgttagtaaccttccgatgatcatccccgtccaatacactgtaactgttatcgttgccaaagagttggggatatcccatttctcagagaaaatggaggggataaaatgtacaattgaaacttcactgcctccgtaaaagaagaagtaagcccccgccaaggcaataaacagcaatccgtgtgaccgataaccggtgctttcttttttagtgtcatcggaagagacctcttttcggatgagaagctgatcaatactgccgaaactcatctgcttccatgcgattaaaagtgcaaaactggataaccctaatactaaaaaagcaattgtccacatgtggttgttgataagaaagcctgagagcagaggcatgaaaagcgcgcctaatccgtaggccacttccatcttgctcatggccacagcctgtctttctttaatagcggtgaggatgatcgtgcctacacaggattccaccaatccggcgccaagccccgcgatgctgacgagaagaaagagcagcggccagggcggcaggaaggtgatgaacatttcgcagctgatgagtgccaggccaaagataacgacgtttttgcgcccaagctttttcaccatgtatggcatgccaataacaccgatgagaaagcccatgaactgagagaataccaatacaccgccattactgtagctttgtgaataatgtgtgagtaactcaggcagtacggctcccagaataacaagtgtaaaagcaatcgatccataagaaaaacagcttatccacagcagacgagatttcatcattttatctccttattcgtaaaataatatttctctctactcgtatgacatgacgtttttacaaaaaatccaagtattgttactatatcacataactttttctcgtacatcccttatggtaacgttaacaaattgttaacattttttacaagaaagatcgttgacaatattttcaataattaatacgataaaaagcgaaattctaataatttcataggggtggtatttgtgggaacgaaggaaatcacgaatccagacagcttgtattacagtgttgacgatgtagtaatggagcgcggagaagggatttacctgtacgatcaagaggggaatgagtacattgattgcgcttctgccacatttaacttgaatttaggatacggtaacaaagaagtcattgatacggttaaagaacaagccgataagctgatccatgtgacatcatcttttcaaacagacgccgtaaataaactggcagaaaaactagtagaaatcgcccccgataatctcacaaaagtacaccctaaagtcagcagcggttccggtgcaaatgaaggagctattaaaatggctcagtattactccggaaaaaccgatgtcatctccttatttcgaagccacctcggacaaacgtatatgacttccgctttgtccggcaactcattcagaaaagaacctttcccgccgcaaatttcttttggccttcaagtccccgatccgtattgcagccgctgtttttataatcagaaacctgattcatgcggtatgctgtgcgtagaaagaattaatgattttattgagtatgcgagcaatggaaaaattgccgccatgattattgaaccgatatccggaaacggtggaaacgtcgttccgcctaaagagtattttaaacagctgagacagctttgtgatgaacacgatatcgccctgatttttgatgaaattcagaccgggttcggacggacgggcaaaatgtttgccgcggaccacttcgatgtgaaacctaatatgatgacggtagcaaaagggctcgggggcacaggcttccaagtcgccgccactctgacggaggacaagtataccgggcttccggggtatacgcactccttcacgtacggctcaaatgtgatggccgccgctgccgcgtgtaaaaccatagatatcatgcagcgtccgggatttttggaaaatgtaacgacggtcggtcattatattatggatcgcttagaaacgatgaaagaggatttcgcttttatttctgaggtaagaggcgtcggtcttatgatcggtgtggagattgtaaaagagaacaatgaaccggatgtggagctgaccaattatattgcaaaacgggcaatggattacgggctgattctccggacatcccgttacgggttcggaaatgtttttaaaatccgaccgcctttaactattacacttagtgaagcagaagtgctctgctacagacttcgcaagctattggaggaaatcaagtgagagactatatcatcgggcttggacaatttgtttatcataaggtgaaaagtcaaaaaggcacgctgaaaaaccggctcgtaaacggctattctccgggaggcgacgcccaatttaacatagacgccgctgctgaggaggcggtgctggattatattcaagataagggccatccggttgctttttacacggaggatggcggcctgaagctgattggagaagatccgcaatatattttaattgtagatccgatagacggaacgcgtccggccgccgcggggcttgaaatgtcgtgtatttcgattgcgcttgcttcgtataagccaaacgcaaagattaaggatatcgaatttgcttttttgcttgaattgaaatcgggcgcttacatgtacggtgatatttacagcgacgccattcagtttgaggggtatcagggagaattgccgaatttgagcgaagtgcgggatattaaaaatatgttttggagccttgagtttaacgggcatccggcacagctgatgacggatgcatacggtcatctgattgaccggtcagccaataatggcggggtttttgttttcaacagcgcttcttattcgatttcacgaattatcacggggcagatggatgcttatgtggatatcggcaatcgtctgctgaaagatgatccgaagctgctttcagattttcagcaggtcggaaacggagaggtgctgcatttgtttccttatgatattgccgcaagcgtctttttggcgaagaaagcaggagtggtcattacggatgcatacggccggtctttggacgaaacgcttctgacagatttaagttatcagaaccagcaatcatgtattgcggcatcaacgaaggagcttcatcaaacattgttagaccaaatccgctggggcagaaaggaagagaaatatgaaggcgttggtctggactcctaatgataagcttgaatatcaagaggtggacgagcctcaaattcggaaatccaatgatgtgaaagtgaaaattttcggcaccggtatctgcggaacggatttaaatgtgctgaaaggaaaaatgaatgcaacccatcatatgattatggggcatgaatcggtgggagcggtcgtggaaatcggaccggacgtgacaaatgtaaaagtcggagaccgcgtcgtgatagatcctacgcagttttgcgggaaatgtcattattgccggagagggctgacgtgttattgcgaaaccttcgaggattggcagctcggaatcggggcgcacggaacgtttgcggaatattacgtcggagaagacaggttcatgtacagaattcccgattcaatggaatgggagcgggccacattggttgagcctctctcctgtgtgctgaatgttgtggacaaagcttcgattcagccggaggactcggtcttggttttggggtcggggccaatcggactgcttgtgcaaatgatggtgaaaaaactggcgcgattgacggttgcgactgaaataggcagtttccgaagcgaggcggcgagccggatatcggattatgtctaccaccctgaagcattaaccgtggatgaagtgaaacggattaatcaaggaagaaaatttgatgtaatttttgacgcgatcggcaatcagcttgattgggcttatccttttattgaaaagggaggcagaatcgtgccgatgggctttgatgatacgtatgagatgacagtcaggccgtatcagctgctgtcaaacggcgtaacgattgtgggcacaggtgaagcccgtcagatcatggaggctgcgttagcatgtgcatccgaccttccgcagctctatgattttattacggaaaagacggaactgaagaattatgaagaagccattgatcatctcatgggcatcgacccggtgacaaaagaaagaaaggatatcagcgcaataaaaacgattcttgtgtctgatccggaacttttataaaagcggaaacggctccagtgagagccgttttcttttcttttttatacggtcttgcacatttctttaaagtttaatatgatactctttgttaaccattcctttcctcaagacattatactctgagcgtgtccccttttccccgtaagcttgcctcatattccccagataaaaatcaatgtttccaactgataaggtgcggatttttatagtgaaaaggagtcgttatcatttgaaagattatacgttacagcagcaatggttcgggaatgtccgtaaagacattctggccggtattctggttgctctcgctctgatccctgaggcgatcggattttcaattattgcaggtgttgatccgatggtcgggctttatgcatcattttgtatcgcgattattatttctatcttcggcggcagaccgggaatgatttcagccgctacgggttcaatggcggttgtcatggtgacattggtggctgattacgggctgcagtatttgtttgcggcaaccattttgacaggtattattcaatttattcttggtgtcagtaagatagcgaaattgatgaaatttattccgcgttcggtcatgatcggatttgtgaatgctttggcgatcttgattttttctgcgcagctgccgcagttcaaaggagcttcatgggtcatgtacgccatgcttgtcggatcactggctatcatatatcttttgccgaaggttacgacggctgtgccgtctccgctggtggcgattattgtcatgacgatcattgcggtggtcttccatgcggatgtccgcacggtcggtgatatgggcgggattacaagttcacttccgcatttcttgataccggatgttccgtggacgtttgagacattgcggattattttcccgtattcactggcgcttgcattcgtcggattgcttgagtcattgctgacggcccagatcattgacgaaatgacggatacggatagtgataagaacaaagaaagccgcggacaaggcatcgccaatattgtgaacgggtttttcggaggcatggccggatgcgccatgatcggccagtctgtcattaatacgaaagccggcggtcgcggccggttgtcggcttttacggccggagcgtttttaatgtttttaattgccgtattaagcggtatcgtcgtgaaaattccgatggctgcgcttgtggccgtgatggttatggtgtccatcggcacgttcgactggtcatcgattaaaggtttgcggaaagcgccccttactgattcgatcgttatggtgattaccgtcgtgacggtcgttctgacaaatgatttatcgaagggtgttttcgcgggtgtgctgctaagcgcgatcttttttacggcgaaaatttctaagctgaagattgtgtcacattccgaacagaaagatgtcagaacttataaggtaacgggacagatcttttttgcttccgtgtctgaactgatgaatgccatcgtttatgatgaagacgtgaaacggattatcatcgatttgactgatgcccacgtgtgggatgattctggagcggctgctcttgagaagattgtcgccaaatgtaaagaatacggaattgaggctgaattaaagggattaaatcagaaaagccgagatttaatgaaacaaatggcatagaatttgtgaagtccggatgaatatatccgggctttttttcggttaaatttgccggtgtgcattgttataatgaatgagacttgaaaaccgtatataggagacttgcatatgatgtggcttcagaagttgaaccaagtgttggggagaatcatgccgcttttgactccgtctagtgtggcggcgggtgtgctgttatctcagcatatcagctggatggccggcgctgtgccgtggatatttgcatttattacatttacgggcagtctgagtgccaattttcaatcgctgaagcgcagtatcgagaagccgctcccgatgatcatggcattgtttgttctgcatattttcatgcctgtttttgcatggggaagcggccatctgattttcagcggtgaccctttaactgtgacggggctgattatgggtgtggtgattccgaccggaattacgagtttgatttgggctgcgatgtataagggaaatgtcggattgacgctgtctattatcctggttgataccgtactttctccttttatcgtaccattaagcctgtctgtcctggccggggcgaatgttcagatggatgtgtggggcatgatgaaagggctggcggagatggtggtgattccgtccatcgcagggatgatggtcaaccagttttccccgccggtaaggactcaggcgataagccggtcactgtctcctttttcaaaaatctgtctgatgattgtcattgccattaacagttcggaaatcgcgccgtatgtcacgcacgtggatatcaaatttgcgggcatcgcaggcacggtattttttattgccatgacgggttatgccgtggcttggctgatcggaagactgatgaagcggagccaggatgaaatcgtgtctctgatttatacggggggcatgcgcaatatcagcgccggagccgttctcgccgtgtctttctttccgtctcaagtggcggttccggtcgtcatcgggatgctctttcagcaaatccttgccgctttgttcggctatttgctgagacgctttgagcttaagccggtcgtgatcaagtatgaaaaaaaccgctcagtcacgtgagcggttttttccgtacagccagcttagtgctgaattaaattgtcgtttgaacgcttcttgatggtgcacggcgccctcttcgatcgtgaatgagagctgagattgagaaaagcctttttgcctcaggcttttgtacacgtctttattttgtccgatcatggtgttttggatgttacatttttgctctgcttcacggctgccgacagacataaagatacgctgccgtgccggccgcaaaggtgcggagcggacataatctgctgatttttcataccagaaggaaccggaaatacagccgattctgccgaatatttcaggcttttgcagcatcgcgtatatcgaaaacagtccgcctaatgacgcaccgatcagtcctctcgtttccggatgcgcagaaatgtgatgcgtatcttcaacagtgggaataatgacatttgtcagctcctcgagaaagagcctccctttgccgccgaaatcatgaaacgcagggctcagggaaggcgcgggccacggtgtgtactcatcgagtctgtcagccggtttgatgccgatgaaaatcaattcgggaagtgttccgttcgtaaattgggattcaagcttatctatctgttctaaaaacaaagaacccccgtcaagtacgtacacacagggtaaagcccctgtttgaaccgaataggaaggaggaagatacacagtgcattcccttccgtttatcgggtgttctgtaagggtgcctctcatgcgtccatcccctttttttgcttaaacagaagaaaaaagaaataaggaacgccgagaattgcaaggataattcccgccggcacttctgaaggctgaaagaacaatttgcccgcaaagtcggcggatatgacgaggagcataccgaccagtccgctgaccggtaatgagtatctgtgctcaatcccggcgagcctgcgggaaatatggggcgcgatcagtccgacaaatgccatgctgcccgctgcggttacacatgcgctgatcaaagcgatgcaggcaatgagcaaaatggttttttctttattggttgaaacaccgaggcttttcaccgtgtcctcatcgaaacgaatggtatcaagcaatgacgttttcgccataagaagaggaatgaacaagatcagccacggaaggattgccgtaatggtcatccagtttgccgaccagatgctgccgtttttccaaaccatcgccatctcataatcctgcgggtccatttttaatgatagaaataaagacagcgcgctgaatccggaattcatggcgatcccgacgagaataattctgcccgattccagatgcccccggtgccaggcgaaaatatagatcagcacggccgccatcagtcctccgatgaggccgaagacaggcatacccatcgcagaggcaagtgccgtcgcttcagattgtccctgaaacagaagcataaacgtgacgattcccgctccggctcctgcattaatgcccaaaataccgggatcggcaagaccgtttttggtaatggcctgaataacagctccggctatccccaatccgagtccgatggcagcagccatgactatgcgcggcagcctcagctgaaacagcaaaatgtcatattgcggattcggatggatgcggaaaagcgtactgagcagttcacccggctttgcggaaaaagaaccgcttgtcatgctgaaatagcttacgagcaatatgagagcaatcagaatgatataaattcctgccattttacgcaccacgctgatcccctccttttcttttaatcaaataaagaaagaaaggaacaccgatgatagaagtgacaacttcaataggcgtttcaaacggataattgatgaatcggctcgcaaggtcgcaaagggtcagaaagacgccgccgataatgcacgcgcatgggatcagcctgctgtagtccgatccgacgagaaaacgtgtgatgtgcggaacgactaaaccgacaaaggcaatttttccggcgagcgccaccgagcttccggtcaatatgacaacagccgccatcgccatgagtttgatggttcttttctgctgtcccagactttttgaaatgtcgtctcctaatgatacggcagtgacctttttgctgagaatcatggccgtaatgattccgatcgcaaaaaacgggacggccagtttcaaaaaatcagggttcatttgatgcagtctcgcactgtaccaaaaactgagatcctgcgaaatttgaaaataaatcgaaagcgcagccgacagactgctgagaagcatactggtcaccgttccgataatggcaagctgcaccggggtaaaaccgccgggaagaatggaggccagcccgaaaacaagagcggcgccgaatgcggaaccgataaacgagtagatgatcatttcaatggatgtcgattgagggagcaataccatgcaaagggtgatgataaaagcggagccgtccgacacacccatgatcgaaggcgaggccagatagttccgtgtgattccctgcatgagcgctccggaaacagcaagggcggcgccgataaacatagcaccggcagccctcgggattcttgaatgccatatgatctgatggtcggtattctccggattaaagtgcagcaatgcggagaacacggtatggatgtcaagctgctttgcgccgtataaaacggaaaggagcagtgacagaacaatagcaatcggtgaagcaatgataataatgtgtgtccgccgttttgcatacatgtgaaaaacctactctttattagtcttgagtcaatttgtcagccgcaacctgtaagaagctgattttactccacgcggttccgccttgggctaatggatcaatcgtattgacgtatacatggtcttttttgactgccttcaggctcttccagatcggatttttctctaagtctttcaaagcgtcaggcttatctgcgttttcgtcatcagaaaattgtacgaagatatggtcagggttcatttcgcttaatttttcaagagaaatcagttcctgcgctttcgccgctttgacttcgtccggcgccttcaggcctaaatcaccgtaaagcgtggagttgaaataaacttgttcaggataaatataaatattgccttgtctgattctgatgaccagcgcgtttgactgtttcgctttgctgttgatctttgtttttgtctttttcaggtcctgttcgtaatctgcgatgatttttttcgcttttttctctttatctgtaagctgggcgagcagcatcatgttttctttccagtttgatgagatatgagagacagggatcgtttcagcggtgccgctcaattttttcaacgttttttccgggaatttggttgatgccagaatgacgtccggctgcagctcaagaattttttccatattcggctgcattttttcccccgttgatacggatttatctgtaatatctttaaacagttccgggaatttgccggagaaagaaattgctcctgccggatgaacgtcaagcaatttggcgtcttccattgattctacgctgcctgtaatggcgattttgtcagtcggcgctttgacttcatatgtttttccgagatattcgattttctttttatctgaagaagcgtcctttcctttacttgctgtatcagttgtttctgagcttccgcaagccgcggccgtgaaagccaaaagcaaaatcatgaaagcgaatgccaatttcttcatctattgttcctcctgttcaattgataactattatcaattggaattatagagaatgaatagggataagaccatggataatttccggcattaccatggacgatcttcggataaaatggaaatgctttgctcgatcatccgctgatgtccgcttggagaatattcaatccacgggtcagatgaaatgggaaacacgcgtttattgctgacggcactaaggttctgccatatcccggactgctgaatccgctgaaaatagcgaagcgtttccggttctttacaagtgaaaagcatgatgcagtcagcctggcaatccgccagcatttccaaggaaatcttttcgtcaggagcaaatgattccggttttgcggaggcaaagtccaaatcaccgaagaagacttcctcaatactgttgttatgggcgatgtacatattttctttatatacacggacaaataagaaccgctggtgccgcacatgtttaagagcatctttcgctgaatgggtgagactttgataagttttaagccagtgccgcgcttcctgctcttcattcagatatgcggctgtgcgaagaaactggtctctccaattctcttgagccggaagataaaaaacttcagtgatgtcattcaggcgctgtttttcttcttcactgacagaatcgagactgaaaataatgtccggggcagcttgagacagcgtatgcaggttctcttcccaatttgcattatagcggtaagcgctcaggtggaccggaatatcggaagagaattgtttgtaataataggccgtccatttcgggtgcagcgccgcagcgtaaggcacgtgatgcagaggaatcagatgccccatcgtttcttttccgtacgcggccatttttgtgcgcctttttttcatgtagcttgtaggtgagctgccggtatgttttttaaagatgcggctgaaataaaattcgtcctggtagccgatttgatgagcgatttcccgcagtttgcagcttgccttggccatcagttttttcgcattggttatgcggatgtctgtgatatattcagttacgctctgcccgtatagttttttaaaggtttcactgtaatgcttgggactgattcccgccatatgagcgagctgggtgagcgtgatttttgtgtcggactgagcatgtatgaattgttttgtctgttcgatcgccgctttcgtattattttgatggcatacttttgcggcataaaggtcgtacatcagctgctgaaagtcggcggtatatttcattttctgcaatccatccgccgatcgcacgttttcagaaagtgattgaagccggcttgtcaaatgatcaaccgtttgtaaattcatttgctgaagtccgtggaagatgtcttccccgttatccggaagcatcgcttcatcatctgaggaataggagaaaacacggagtctgacgatatacaaatggatgccgcctgacgatataggggcaatattgaatgtctcatcacaaggacagatgtagagcgtttccttctgcagcggaaagctgtctgttccgatatcaatttgtccctcgcctttcacatgaaagatcaatacgggggaatcagtgagctgatgctctgacagaaggtcggctgtttttttcacggagatgatatcaatgggctgaaagaataatgtgtttttcatgagaaaccaccttttaggaaacattcatttaaatgataacagttatcatttaaattgtaccaaataaatgaatgttttcctataaaaagcggaaatgtgaaatgcgtcaaaatgttacacgtgtaacacgaatgttgtcagtatatgaggtattgttttcttagagttttgaattggtccagccggcgttgatatgtgccggtgatgtcttcaatggaagcgcctttttctatttttttgcgtacccagccgttaccgatcagcttgtcaaaagagcctgtcggcaagaatgaaaagtcattcggatataagtcatgcatggttttcagaatggagagccctgtttttgccgcttcaaatgtgtttctgtttgttacgtagacttgtacgccgtggcacagcttgccctggtgtttggagaagctggggatgaatgaagcggctctgaaggtgacgcccgaaagcttgagactgttcaggcgttcttcgagctcggtgcttttcatataaggcgcgccgataagttcaaacggctttgtcgtgccccttccttcggatacgtttgtgccttcgattagtcctgttgccgaatatgcaaatatgctgtccggggtcgggatattaggcgaagggaggacgaacggcagaccggtatcttcaatcgtcatcgtccgcttccagcgcttcatttttacgacggtgaggtcagcgccaatatgaaactctttattgaataaaagagcaagctcaccgatcgtcatgccgtgcttcagcgggatcggatacagtccgacaaatgaagcgtaatccggttcaagaaccgggccgtccggatttcgtccgccttgcggattcggccggtccaagacataaaaaggaatgcctttttctttggccgcttccatggcataggccattgtataaatgtaggtgtagtaccgggttccgacatcctgaatatcgaaaatcagcacatctgtatctttcagcatgtcaggcgtcggtttcctcgtctccccgtataggctgtagacgggaagccctgttttttcgtctatataggatgtgactttgtctccggcctgagcatcgccgcggacaccgtgctccggtccgaataatgccgtcaggcggatgtctggcgcctcatacagcacgtcaacgctgcttttcaatgatgcgttcacaccggtcgggttggtgatcagcccgaccctttttcccttcagttcctgtttataatctttcagcaggcggtcgatgcctgtttggatgcttggtttcttggcggtatgaaggtttctgtcagaagccgccgagactgccgtcatagcactgatgacgacaagtccggcgagaagtgcagccgtatgtgttttcataatcagccctcctgtttaaagcggttttccggtcttcagattgataccgaaaccataaggatacagtgtcgttcccggatgcgtgactgaaggaatgtcagcgggcagcctgccttgcggtgttgtctgtccgaatatcgcttcaatgcctgccggaatgtttggctggaggaattgtccgtctgtatatcctttaaagccgtagactgcgataagggcttcagcttcttcaaaattcgcggcgtcgtaaggattacgcaggctcatcagcacaaagggtttttggttcgattgtgcggctttcatgacggcccgcggaaatgcggtcgtccacttgccgggatctgtgacggaatcgtcaatcacgccgtcgtttacgacagggtcattttttacgacataggagcctgtaatcacgtaatccgcgtcggataccagctttttgtgttcatcatgaaatgtgcgctcggcgaagttcattttactgatggttaccggccggatttttttcttcttgatgagctgccgaatggtttgttccattgccgctgtttgatcttcataaggagcggcaatgagaacgcggctgttctttttcggtttgaatgggagcgtgcggtttttgttttgtaagacggtgacggatctttccgcgatttgtttttcagctttcaggtgatttttgctgccgacggttttctttgcttttgcaatcttctttttcagatttgtctctttcggtgcgggatatatccctcgttttattttcagggaaatgatgcgttccgctgatttgttaatttgctgcagcggaatatcccctttttgtaccgccttttttaacgcggaatgaacccgggcaaagcggttttccgtttgcagcgatgtcacttgggccggcatcagggcaatatcgactcctgcttttactgccatgacgaccgcctcttcctgaccgaaatgatcggcaatggctttcatatttaatgcatccgtaacgatgacgccgttaaatcccatttcctcacggagaagatgagtcatcacttttttcgagagtgtggcgggtacgaggatgtctgaaccgtccagcttgcttttataggttgtatcgtcaaaagcgggaaattgcacatgagctgtcatgatcatatcagctccggcctgaatggcctgccgaaacggataaagttcaatctgacgcagcctttcttgattgtgggtgacaagcggaagaccgtagtggctgtcgacatccgtgtcgccgtgtcccgggaaatgtttgacggcggcagcgacattctgcttttgctgagccttcattgaggcaaggccgagggaagctgtcagatcacggtctgaactgaacgacctgacgccgatgacagggtttccgggattattattgatatcgagaacgggcgcgaaattcgtattaatgcccagtgctttcagttctttcccgataatggcgccggtctgggacgcgtaggctgtttttctagcagccccgagcgccatattgcctgggaaatgagtgccctcaccaagtctagttacgatgccgccctcctgatcaatgcttaataatagcggaatgtcagggctcgccttttgaaaggcatctgtcaggcgtaccgtttgctcagtgttttttacattttctgcaaataagataacgccgccgaaccggtacttttgaataagccctgcgacttcgtcattcatttgggtaagagcctcaggtgatgactgcccctttttttgccaatttcgaaaatcaggcatgagcatctgccctaatttttcatctaacgtcatacgggataccgcttgttccgcctgtgacggaatgtccggttttgttgatgcatgatgcgtgccgaatacaatgaacaacagtaatacagctgagatgaaaagtttcatgatggtgccctcctgccgtcatagtttggacaaaagacatgggttgtcattcaatggcttcataaatcgcttttatgacgctgccgtagcttccggtcgggaaaagatccccttcaaaaacattcgggttttcaccggggctgacgacgggggaatgctttttattggtcaaaagtgcgatccccagcttataagcgggatcaataatcgtgatggtgccggtccatcccgtatggccgtatgcctgcctgcttgcataaggtccgaacatccactccatatccgggctgccgtttttccgccagccgagagcgaaagtcggatcagaggatgccgccgttgtgaacaaatcggccgttcttttattgaagagagaaacgtgtttataactgcctctgttcagcatgacttgaagaaggacggccatatcatcagctctggaaaacagcccggcgtgaccggacacccctcccattgagtaaaatgctttttcatcgtgaacttccccctgcagcgtatatgtcctgatgtgagggaaatggatgactccgtcacgtgtgttgcctaaacgttcagtagctgcgaatgctttttctttaaaacctttttgcagcggattgaacagtgtgtgcgtcagtttcagcggtttgtacagttcttgttccgcataggtatcaagggtttttccggttatgttttcaatgatgcatccgagaatcatgtaaccgatatcgctgtatacgtgttttgttcccggcttgtattcaagcgggatctgggtgagaaaacggattgttttatcccgttcttgtgaatataaagggcctgcggtgtccggctgatagaaataaaagcttgccggcagaccggattgatgctggagcacatcgatgacgcgtatacggtctttttcttgaatcggatcgctttttctgtctttgaaatcaggaaggtaagccgagactttttgatacacatcaagctttccctggctgacgagtcgctgtagtgcaaaattggccgcgtacatttttgtattggaagctaaatcaaacatggttgatgttttcatttttttcggacgggataaaagggtgttcccgtcatattttttgctgtagccgtatgctttctttttgatcacccgtccgtcctttacgacgatgaggacggctccggggaatcctgctgcgatgtctttttcaatcatttgatcaacctttctgagctttgctgcgtcgtataatttggattgggcttcggctttgtgctgcggcagaaaagagaggctgatgaccattgtgagtatggcggctgtcagtgttttcatattctgatccctcccggtttattcaaattcagcagccatgtcatccttaaatccgaacgcataagtgaagacaaagcctgccgcgtaagagatgaagagaccgatgatatacaaaacgatttgagccggctgtacgagaaacgagagcggaaggccggagacaccgattgaaaaagtcgccacttgaaaatgggcttgaaaggcgccgccgattcccgcccctaaacacgccgtcaaaaacggccggccgagcgggagcgtgacgccgaagataagcggctctccgattccgagcagaccggatggaagtccgccgccgatcgctctttttaatgaggctttttttgttttcataaagatggcgaaggccgcgcctacttgacccgcgcctcccatcgcgagaatcggaagaagcgggtcatctccgattgatcggattaattccaaatgtacgggagtcaagccctgatgcaggccggtgacgacaagaggcaggaaggcggctcccagtacaaaccctgagagcactcccccgacattcagcagcgacaataaacctgatgtaatcagatcagaaataaaaccgcctgcagggataaaaacgacatatgtcaccagcccggtgataagtaaagacaatgtaggcgtgacgataatgtcgatggattgatggacgtactttctgataaaccgttcggtataagcgataaaaaccgcagcgaaaagaacgccgattaatcctcccctgccagggagcagattctctccgaacaaactgatattggcgatctcagggttaaggatcaatatgcccgcaaggccgcccatcgcgggtgtcccgccgaattccttcgccgcattgatgccgacaaggacgccgaggtaagcgaacaagcctgaaccgataaccgttaaaataagtgcgatttgggattctttcgggagccagccggcctgaatgacggctttcgtaataccggtgattaaacctgatgcaatgagtgcaggaataaggggaatgaagatgcttgatatttttctcagaaacaatttgatgggtgtggtgttttttctgttgagatcggcttttttccgtgaggcggcttcttttaaatcaatgttttttccggatggcataagttttgcgaaagcgtcggcgacatgattgacgacacccgtgccgagaatgatctgcagtgtttcggcttcgacgacgcctattaccccgtcaagccgtttcagcgcctcaatatccgttttgtcccgatctaaaggtgtaatcctcaggcgtgtcatacagtgggtaaagcctgaaatattcgatgaaccgccgcaattgtccaggatatctttggccagtgactgataaaatgcctctttgctcatggagatcctcctttttctgtacgatttttcccggggagctatgcctgaaacgcgtcctaaaagcgcctgcgccgaacatgaaaacggcgcgggctcgtaaaagcacaatatttttctccaaagaacgatcagcgttctttttctcttgaaacgtgctgttcaatggctttatcaatgaatccttctgattctttgagcagtgccttcgcgtgtgtttcgtccgaattcgtcttcagcatgacgattgccgttttgacatggctgtctgcggcctcaagcgtttcttttgccttgtcgtacggaacgcccgtgatgctttggataatgccgattgcgcgttctttcaatttttcgttgctgacatgaacgtccaccattaaattttcgtacactttgccgcttttaatcatcacggccgtggaaatcatgttcagaatcattttatgtgccgtcgcggctttcattcgtgttgaccctgtaatcacttcggggccgacaatgacttcgatgctgtgatcggcaaaggtgctgatcaaggagtccttattgcatgtgagcgcgacggttttggcgccgattgtttttgcatatttcagcgcaccggccgcatacggcgtgcgcccgcttgccgcgatggcgatcacggtgtcttctgcggtaagcccgatcgttttgagatcgagagcgccggtttcctcgctgtcttctataccttcagccgcttgcaaaaaggcgtctgcccctccggccatcagaccgatgacggtgtcgggacttacgctgtatgtaggcgggcattcaaccgcatccagtacaccgagtctgccgcttgtgcccgctcccgcataaatcagcctgccgtttcgccgtaaggactgatgggcgaattgaacggcaatctgaatatcgggcagcacctgctgaacggcttcagccactttgaaatcctcttcgttaatgatgcggagaatttccattgtgtctgcctgatggattgaagcggtctgcggatttctggtttctgtggtcaatctgtgaatgttaagccggtctgtcatgattgtaccctcccaagtcgttaatacttgaagtatatgggcttctgaatagatgtttcaagaaaaatcggcagggatgagatgaataatcaagcgctttcacaaaaaatgatgcagaatgtgctgttcaccgatcgggccgatcctgcgccgccctttgtcaataaaaccggaagaccggtacaggttctttgcacgttgattgcgatggtttacagcaagcacgatttcatcacaccaaggaaagtaatttgcgacaaaagcggggagctgcagcatcgcttgtttggcataaccttttccctgatgcggcgcatgtaatgacagcgcactcagcaaaatggcagacacattgttcgaatacggagcaatggtttcttttgaggtatgtaaaataaaaaaaccgacggggcggtcttcttttaaaatgactgtcgggtagcgatcccggatgacaagcgcctgcggcaggacatctatcggcagagctgtgaactttttatcttcttcactcagcacaaacccgttcagcccgtctgcatgctccggtttataaaaggacagggctacatccatgatatctactctccttttttataattgatccaattcatcttctgatagaacacggcagcctgcccgttttaaaagagcggaagtgatgccgtctccgagtattttttttcctgagaaagtgccgtcatagataaagctgctgccgcaggacggactgttttctttaaggatgaccgttgcggcgcctatttcttttgcgtatgctaacgttttttccgcgccgtccatatataaagctgtaacgtcttcgcctgatgccgttacgattcttgccgttccgttcagcacgtcttcacccgtgccgccgatgatttccgccggttcgcggggagtggtgaagccgcccaaaagttcggggcagaccataacagctttcttttcttctacgagtctgcggattttttccgaagcggcgtgagagccgttatatctgcattcgataccgccgagacaagagctgactaagatcatctgtgtccattcccttcaatattttgatactttcatcataaatgaaataagagaggagggatgagtttttcagttaaaaaacgggtaaaaaagtttgaaaataaaaaaaataatttttctctttacaaatggggtacaacctgtatataataacttttgtcagctcgacgcggacacagcggcccgttggtcaagcggttaagacaccgccctttcacggcggtaacacgggttcgaatcccgtacgggtcatatggaggattagctcagctgggagagcatctgccttacaagcagagggtcggcggttcgagcccgtcatcctccaccatatttgccggcctagctcaattggtagagcaactgacttgtaatcagtaggttgggggttcaagtcctctggccggcactgttttccaaaaaaatacggaggggtagcgaagtggctaaacgcggcggactgtaaatccgctccctcagggttcggcagttcgaatctgcccccctccaccatttttgggctatagccaagcggtaaggcaacggactttgactccgtcatgcgttggttcgaatccagctagcccagtctcagacaccttttgcataaaggtgtctttttttatcggcattttgtttcggtttttgattgttcatcagatatactatttttaagctgctgttaaggcagtatattctgtattttccatctacaccctgcctgaaatttggtaaaataaatgtaataaaaaaatgaaaccttttaaaacaatcaacgtatagatacagaccggtgaagggcagaggtaagataaaacatggaaaacctgattaaaaaaagaatcaagcaagtcaaaaaaggcgatcaaaatgcgtttgcagaaatcgttgacctttataaagataagatttaccagctttgctaccgcatgctcggcaatgttcacgaagcggaagatattgcgcaggaagcttttatcagagcgtatgtcaatatcgacagtttcgatatcaacagaaagttttcaacgtggctttacagaattgcgaccaacctgaccattgaccgcatccgcaagaaaaagcctgattactatctggacgcagaagtagcgggagcagaagggctgacgatgtattcgcagatcgccgcggacggggttctccctgaagacgccgtattgtcattggagctgtcggacacaattcagaaaaagattttaaagctgcctgacaagtacagaacggttattgtattaaagtatattgacgaactctctttaattgaaatcggggagattctgaatatccctgtcggcaccgtcaagacaaggatacacagaggcagagaggctcttagaaaacaattgagggatctttaagtggggtgatgaaatgagctgtcctgaacagattgtgcagcttatgcataagcatcttgatggagatatccttcctgaagatgaaaacgtattaaaacaacatttgcagtcatgcgggaattgcaaacggcattttcatgaaatggagaaatccgtagcactcgtccgaagcacatcgcatgtcacggcccctgctgattttactgccaaagttatggcgaatcttccaaaagagaaaaaacgcgcttctgtaaaacgatggatcaaaactcatccgatgattgcagccgcagcggtttttgtgattttaatgggcggcggttttttcaacagctggcataatgaccacaatttcagtgtgtccaaacagccgaaccttgtcgtgcagaatcacacggtcaccgtccctgaaggcgagaccgtaaagggcgatgtcacagtaaaaaacggcaagctgttcattgaaggaaaagtcgacggcaatgtgaccgtcgtcaacggagaaaaatacatggcctcagccggacaagtcaccgggcagattgaagagattaaccaattgtttgactgggtctggtacgaactgaaatcggcgggacagggcgtcgtaagcgctttggacccgaatgaagatgagtaaagcgtataatcgctttactctttttttgtgcaacgccgcgccggctcatttcacttgagaaatcaaaatgtggtataatgagcacgctatatgatgtacatattgctcatgcagcacaattcataacggaaaaaacgaaatgactgaattcttggaggacgaggaaatggcttttgaggacatcccatttttgcaatacctcggcaatgccgttgatattctccttgtttggtatgtgatatataaattaatcatggtcatacgcgggacgaaggcggttcagcttttaaaaggaatcgtcgtcatcgtattggtccggatggccagttcatatttgggactcagcacgcttcagtggctgatggaccaagcgataacatggggatttttagcgatcatcattatattccagcctgagctgagacgggcgcttgaacagctcggacggggccggttcttttccaggagcggaacccctgtggaggaagcgcagcataagacaattgaagcgattacaaaatcgatcagctacatggcgaaacgccgcatcggcgcactcatcgccattgagcgcgatacgggaatgggcgattatattgagacgggcatcccgcttaatgcgcaggtcagctcggagcttttgattaatatcttcatcccgaatacaccgctgcatgatggagcggtcattatgaaaaataacgagattgctgcggctgcctgttatctgccgctttctgaaagcccgtttatttcaaaggagctggggacgcgtcacagagcggctgtcggcatcagtgaagtgacggacagcttaaccattattgtatctgaagagacgggcgccatcagtgtggccagaaacggagaccttcacagagaattgacggaagaagcactgaaagaaatgcttgaagccgagtttaagaagaacgccagagacacttcttctaaccgctggtactggaggggcaagaaaaatggataaattcttaaacaaccgctgggctgtaaagatcattgcattgctcttggcgctgctgctttacgttgcggttaacaacaaccaggcgccgactccgaaaaagccgggggaatccttttttccgacatcaacgactgacgaggctacgcttactgatattcctgtaaaagcatactacgatgaagcgaactatgtcgtcaccggcgtgccccagacggtaaatgtcacgattaaaggctcgacaagcgcggtgaaaaaggcgagacagacgaagaattttgagatatacgccgatatgaataagctgaagaccgggactcataaggtcgaattgaaggcgaaaaacgtatcggacggactgacgatctccataaacccgtcagtcacgacggttacgattcaggaaaaaacggctgagagttttcccgtggaagttgaatactacaataaaagcaaaatgaaaaagggatatacccctcagcagccgattatcagcccgaaaaacgtgcagattacaggttcgaaaaatgtgattgataacatttcacttgtcaaagcatctgtgaaccttgaaaatgcaaatgagaccattgaaaaggaagtgaaggtgaccgtctatgacaaagacggcaacgcacttcctgttgatgttgaaccgtcagtcattaaagtgacggttcccgtagccagtccgagcaaaaagcttcctttcaaaatcgaaaggaagggaagtcttccggacggggtgagcgttgcgagcattgactcgaatccgagtgaggtgacggtttacggcccgcaggatgtgctggattcacttgaatttattgacggcgtatctcttgatttaggcaaaattgataaagataccgatatcaatgccgatatcccgcttcctaagggtgtcactaaggtatcaccggaaaaaatcacgcttcatgttaaagtggacagtgaagacaaaaaggattttgacaatgtcgcaatcaagacggtcggactgggaggctcacagcagattgagtttctcgaccctgaatcgcaggcgataaatattacggccaaaggctctcccgccaacattaaggcgctgaaaaagtcggacattgaactgtatgccaatgtctcggacttggatgacggagagcactctgtaaagcttgaagtaaacggcccgcaaaacgtcacatggtccctgtcaaaagacacggttaagatcaagctgacttctaagaaaaacacaagttcaaataaaaatgacggcggctccgctgattccggcaataagaacggcacaagcggagacgcagacaaagacaagaacaagaaccgggaagacgacactgacagcgatcagaataaaagtcaaaaccaggatcaaaatcaagaccaggatgaagacggatcaagcgctgattcttcttcaacagaatgaaaaaggagcgatacaaaatgggcaagtattttggaacagatggtgtaagaggtgttgccaacagcgagcttacgccagagctggcctttaaagtggggcgttttggcggttatgtcctgaccaaagataagcagcgcccgaaagtgctgatcggccgtgatacacgtatctccggacatatgctggagggagcccttgtcgccggacttttatcgatcggagctgaagtgatgcgcctcggcgttatttctacgccgggggtatcctatttaacgaaagccatggatgctgaggcgggcgtcatgatctccgcttctcacaaccccgtacaggataacggaattaaatttttcggaggggacggctttaagctttctgatgagcaggaggccgagattgaacgtctcatggaggaaccggaagataagctgccgagaccgacaggcgcggacctcgggcttgtgaacgattattttgaaggcgttcaaaagtatctgcaatttttaaaacagacggcggacgaagattttacaggcattcatgtagcgcttgactgcgcccatggtgcgacatcttccattgcgacgcacctttttgccgatctcgatgctgacgtatctacaatggggacgtctccgaacggattaaacattaatgatggcgtcggttctacacacccggaagcgctgagtgctttcgtcaaagaaaaaaacgccgatatcggccttgcgtttgacggagacggcgaccgcctcattgccgttgatgaaaaaggaaacatcgtcgacggcgatcagatcatgtacatatgcgcgaagtatttgaaatcagaaggccgtctgaaggatgataccgtcgtatcgaccgtgatgagcaacctcggtttctacaaagcgcttgaaaaagaagaaatcaaaagcgttcaaacggcagtcggcgatcgctatgtcgtagaagcgatgaaaaaagacggctataatgtcggcggcgagcagtcagggcaccttattttccttgattacaacactaccggcgacggtcttttgtccgcgatcatgcttgtgaatacgctgaaggcgtccggcaaaaccctttcagaacttgcggatgaaatgaaaaaattcccgcagctcttagtgaacgtgaaagtgacggataaatataaggtagaagaaaacgctaaggtgaaggccgtgatttctgaagtggaaaaagaaatgaacggagacggccggattttagtgcgcccgtcaggcaccgaaccgctcgtacgcgtgatggcggaagcgagaacaaaagagctttgtgacgaatatgtcacaaaaatcgtggatgtcgtgcggacagaaatgggagcggagtagcgaagtttataagcagagagcgaacaagacaagtgcgatcagcataaaatgatagtaaacatgatgccggggcggcaaaaaataattgaccgtccttggcacatgctgtaaaatcaagcttgttcagcctttgtttttcacttgcaggaaaggcgggattgtttgcatcttttataattacagcgcccgaactaagcgcccgaaaaacggcttagttgacgaggatggaggttatcgaattttcggcggatgcctcccggctgattcatttagatcacagccgtaaggatttcttcaaaccggaggggcgactctccgaacaaagggaaatcacatgatcttccaaaaaaacatgtgggaggggacgattgaaagtccccttgtaatttgactttcttcgtctccttttacacctttaggaggaagaaaatatgtgtggaattgtaggttacatcggtcagcttgatgcgaaagagattttgttaaaaggattagagaagcttgagtaccgcggctatgactctgccggtatcgctgtggcgaatgagcagggcgtgcatgtgtacaaagaaaaaggccgcatcgccgaccttcgtgaagtggtggaccacacggttgaatctcaagcgggaatcggccatacacgctgggcgactcacggcgaaccaagcttcctgaacgctcacccgcatcaaagcgcactcggccgctttacacttgttcataacggtgtgatcgagaactatgttcagctgaagcgcgagtatcttgaaaacgttgaactgaaaagcgacacggacactgaagtagtcgttcaaatgatcgagcaatttgtggcgggaggactcagcacagaagaagcgttccgcaaaacactgactctgttaaaaggctcttacgcaattgcattatttgacggtgaaaacacagacaccatttacgttgcaaaaaacaaaagccctctgttaatcggccttggagatacgtttaacgtcgtggcatctgacgcgatggctatgcttcaagtaacgaatgaatacgttgagcttttggacaaagaaatggtgatcgtgacaaaagacgaagccgtgattaaaaatcttgacggtgaagtcatgacacgtgcgtcttatatcgctgagcttgacgccagtgatatcgaaaaaggcacataccctcactacatgttaaaagaaacggatgagcagccgcttgttatgcgcaaaatcatccaaacgtatcaggacgaaaacggcagactggccgtggcgggcgatgtcgctgacgccgtggcggaagcggaccgcatttatatcgtggcttgcggaacgagctatcacgccggtcttgtcgggaaacaatatattgaaatgtgggcaaacgtaccggttgaagtgcatgtagcgagtgaattctcttacaacatgccgcttctgtctaagaagccgctctttatcttcctttctcaaagcggagaaacagcggacagccgcgccgtgcttgttcaagtcaaagcgctgggtcacaaagcgctgacgattacaaacgttccgggatcaacgctttcccgtgaagcggattacacattgcttctgcacgcaggtcctgagatcgcggttgcatcaacaaaagcgtatacggctcagattgccgtcctcgcgatcgttgcgtccgttgcagcagaacgcaacggcgttgatatcggttttgatttggtcaaagaattaggtattgcggcaaacgccatggaagccctctgcgaccagaaggacgaaatggaaatgatcgcgcgtgagtacctgactgtttcaagaaacgctttcttcatcggccgcggccttgactacttcgtgtgtgtcgaaggcgccctgaagctgaaagagatttcttacatccaggcggaaggcttcgccggcggcgagctgaagcatggaacaatcgctctgattgaagaaggaacaccggtctttgcgcttgcgacacaagaacacgtcaacctgagcatccgcggaaacgtgaaggaagtcgcggcccgcggcgccaacacttgcatcatctcgctgaaaggcttagaagacgcagacgacagattcatcctgccggaagtcaaccctgcgcttgctccgctggtttctgttgtgccattgcagctgatcgcttactatgcggcactgcaccgcggctgtgacgttgataaaccgcgcaaccttgcgaagagcgtgactgtggaataatatatttaacccctttggttattagccagaggggttttttaatgcggaaatgagaaatgcatactctttgcgattgtaaagaaatccccttttatatattgaaaaggagtaacacctgctttataatacgagatgcattccggttaaaatccataaatgtaatcattagtaaatcattttgtgtatacctcatcggaaagtaaacacctcagcagttttcatcatgaatatcccattatataaacctaatcaatcgattacacttccatattatgcttaagactttaaaatcccttttgtatttcccgactcctgatccattatgaatacctagaccagatatgaaaatcacaacatttttacaataatccggttcaattcttaaaaaagtcctgacaacaatgataggagtggaatgatgtcaaaccttttagaaatcagaaacatcagcaaatcttttggtcataaagctgttttaaaggatgttacattcaatgtgcctgccggatcaattgtcggttttatcggtgataacggcgcaggcaagtcaacaacatttaaaacgatattaggattaatctctcaggatagaggtaaagtgaaaatctttggtaaagagaatctggataaacatataaagtttaaagaagatattggggtcgtatttgatgcgatgaatcttcccgcgcaccttacgataaagcagctgaatcatgtatttaagaaactgttcgacgcttgggaccaagatcaattttaccggttggttcattctttctctttacctatggataaaaaagtgaatacattctcgcgcggcatgtcaatgaagttatctgtagctgttgctttgtcgcataatgcaaaattattacttctggatgaagcaacgggagggcttgatccctcttcaagagatgatctgttaaatgaattaaaaagctttgtgagtaaaagcaacggaggtattttactttcatcgcacattatgactgatgtcgagaagatagccagccatatcattatgatgaaagatggcgaaattttattaaatgaagagaaagataaggttcttgaaagctataccgttatagacgttgatgaaggtcaattggctgagattgacgaagatatcgttctagcaaaaaggaatcatggatcttattggagtgtgcttgtatcggatcaacagaaattgccgaatggcgtaacggccaacaccatttccatagaagaaatcagcgtctttttaacgaggagtgaaaacattgagaggtctgttactgactaactattacttggtttatcggagtttctttgcatacacggggttggccatattggtatcagcagtcattttttattttggggatgcttcaatgcatcgttttgttgctatgctgattattttgtttgtcgttatgcccgcacttgaggttataaagtatgagagcaagtcaggctatgacaggtatgttctgactttaccggtcagcagaacaaatattgttcaaagtcactatttcttttatcttttgattgttgtgatcggagctgtaatatcttatggtattttccttgtatacagcctgggttctgatgaaccaattgacggtatatttaatattgtctcttttggaacgttcatcgttctctttgccggtgcaatcgtttatcctcttctctacatgataggcccggaaaaatccgatgctatcgtgattggaggggcaatggggggactttttgctacctttggattgcaaagtgtcgttgggtatgcagcagaacaagtaccgctgtcatttttgcacataaatccttctttatatgtcccgattatatatctcatgatcggcgttatcttatatatcatttcatttttcatcgccgcagctatatatcataaaaaagaattttagcagctgatcaatttataataggataagtgtgtttccagcctttactgcaaagtttcacagtcttggctatcccagagtaaaaggtgaaaaagctgacaaatgatgccgtcagcttttctttatgtgtttttttaaaactcctcatactccgccgggtcttggccgtttatccgtccgtcggggcgggtaagcgagtcgatgatgctcatgtcgttttcatcaagggagaaatcaaaaacagagatgttttcaagctggcgctcgggcgatgctgattttggaatcgggatggcgcccagctggatatgccagcgcaaaatgacttgagaaatggttttgccgtatttgtccgcaatctgtccgagtttttgatcgttcaatacttcgccggcgcgggataacggactccatgattctgtcacgatgccctgttcttcgtgccattggcgctgctgctgctgattaaaagcgggatgcagttcaatttggttgatgcctggctttacaccggtttcacgttcgagccgttcgatgtgctcaggcaggaaattgcagacgccgatggatcggatcaggccccattttttcgcatcaatcagtgcctgccatgcttccgtgtagcggtcttgtttcggattcggccaatggacgagatacaggtcatagtagtccagaccggcgcggtataaagattcttggatggtttgtacagctttgtcatagtcatggtagcgcccgggcagcttggacgtcacgtatagctgttctctcggaacagagcttctgcggatggcttctccgaccgtcccttcattttcatagttataagcggtgtcaatcagacggtagccgatatcaatggcgctggtaatggcatgaacgccattgtttccattaagagcgtatgtaccgaagccgatcgcgggaatgcttgtcccatcaagcagtttcttttgcggaattgccccagtcatcattaaatccctccttgttttctactttaccattattcttacaaatgaaacataataatggaaggaaatgagatgatccgcacatgaaaaaagctgacggagaaccgccggctttaaatttgaaacatccatgctacgacggggccgaagaccgaccctaacacggcgcagagcgtcatggaaacagaactcatggagaccgttaattctccgtactccattgcttttgaggtgccgagcgcatgggaggcgctcccgaatgcaattcctttcccgagtgagctgcggatgcggatccacttgagaagcagcggtcctaagataacgccggaaaaccctgcgatcatgacgaacacgactgtcatggaagggacaccgccgataccggacgcaatctgtatggcgacaggcgtcgtaattgattttgggataattgacaaaatcaaactccggctgatgccgaacagctctgcaaatagcaggccgctgaccattccggagaataaaccggccaacacgccgccgatgatcggaaacatatacttgattaacacccggcgctgcttataaagcgggtatgccaaagccaccacagcggggccgagcagtgaattgatccattgtccgccgatcatatagtctttatacggaatatgaaaaacaagcagcacggcgataatgaaaatcgtagtcgtcaaaaccggtatgagaaaggggtatggaaagcgcacatataatttcaccatagccagataggcggcggccgtgaacaaaattataaggattgcgatacatgcttgctgcacttctttttctcctttctctgattggctttatgctctaacagctggctggcgtaccctgcggcgatcattgtgacgatggtgctcagcacgatgatcagaaacagagcagccccgctggcggaaaacagtgacgggtaattgatgacgcccgtcatggccggaatgaataacagcggaagaaaagacagcaaaaatccggctccgtcttcaatcattttgacgggaatgatcttaaccgataaacatatgatcagcaggatcaaaccgatgatgcttccgggaatgggcaggtgaaagaactgctgaacggctcccccgataaaggaaaatgcgaataaaataatgatttgcaagatgatgcgtatgactttcacaacgatgctgttctttggagaagagcagcttccccctttcttgatgtttctataagtttctttacttttggcacatatatttgtactatacaaatatatgtatgcaaaatctttctatatgttttctgagtaaatgtgcatatgtttgtattatacaactaatgttgctgttgtcaatgtaaggagtgaggcgtttgtcaaaacaagatccgattgaattaattgaatatgaactcaccactttcatcaggagagctgtttatcttgataactccgaccgtaaaatcggacatctggaaagggctgcgtatttgttattacggcagctggatgaattcgggccggcgcgtgtgaaggaattggccgaatcatttaagctggatatttccacattatcacgccaggcagcggccttggagtcgaaagagctgatccagcgtttttccgatccttctgacgggcgggtcagtctgtttgcgattacgaagcttggcaaacagaggttaaaagctgataaaaagatgcgtcttgagcggtatcatcgtatgcttgacgattggtccggcgatgaaaaagaaatgttcggccggcttttgctgcggctgaatgaggcatttatcgattaatgcatgatttttgccgggttaagcaggattatggcgtatacaagggagaatggaagagagtaaggctttacgccattctgcttagcaaaaataatattggatagggggcggaaaacgtttctcctgggaaataatgtttctcggaggctgcggcatttattatctcaatattcacaattcaataaaaatgaaagcgctttatttttagtccgttggttcagagtgtaaggtgtttgcctgaaaaaaacaattgtattttccacgaaaatttattatgatggaataaggaaattggagattatataacgataggaagatagaatatttccaatattgcgggaaatgaagagtgagttaggttcaacaggtgcaccttctgcttcattatttcacatatatcagagctgttaagaggaggaagcgaagtggcaaacaaagaattaaagagaggcttaggcgctcgtcatatacagatgattgcgctgggcggcacgatcggtgtcggtttattcatggggtcatccagcacgatcggatggaccgggccgtctgtcctgctggcttatgcgatctcgggtatctttatcttttttatcatgcgtgcgatgggcgaaatgctctatgtagagccgagtacagggtcgtttgcgacattcggccataagtatatacatccgttagccggctatatgacggcgtggagcaactggtttcaatgggtgatcgtcgggatgtctgaaattatcgccgtcggttcgtatatgaaatattggtttcctgatctgccggcatggattcccggcattatcgccatggccattctcggtgcggcgaatttaatttcagtaaaatctttcggtgagtttgaattttggtttgccatgatcaaaatcgtcaccattattctgatgattgtggccggaatcggaattattttcttcggtttcggtaacggagggcatgcgatcggattatctaatttatggtcgcacggcggtttctttacaaatggtttttcaggatttttctttgctttgtctttggttgttgcggcctatcaaggggtcgagctgatcggaattacggcaggggaagcgaaggacccgcaaaaaacgctgcgaagcgcgattcagagtattatctggcggattttaattttctacatcggtgcgattttcgtaatcgttaccgtatatccgtggaatgagcttcactcactcggcagtccgtttgtttcgacatttgcgaaagtcgggattacggcggcggccggtctgattaactttgtggtgattaccgctgcgatgtccggatgcaacagcgggatattcagtgcgggacgtatgctttatacgttaggcgtgaacggacaggcaccgaaattctttaagaaagtttcttcgagcggtgtgccgatattcggtacgcttgcggtattaatcggacttgtgatcggtgtcgtgctgaactacatcgcgcctccgaaaatctttgtttatgtgtacagcgcgagtgtgctgccgggaatgattccgtggttcgtcattttgatcagccatctcggtttcagaagagcgaaaggcgctgagcttgataagcatccgtttaaaatgccttttgcgccgtttacaaactatttgacgatcgctttcttactcatggtattgatcggcatgtggtttaacaaagatacgcggatttctttggttgtcggggtgattttcctggcgattgtgacggtcagctattatgcgttcggtatcggcaagcgcatgcctggtgaaaaatcgaaaatagaagacgctgtataattcaaaaagacacctctcttacaggggtgtctttttcggcttgtccgcgagtggtatactggttaaaaaaagcagaaccgggggaaacatcgatgagtcattaccgtacgttattatttgatatagacaatacgctgctggattttaccgcttcagaaaccgatgctcttcaaaaattgttccaaggttcaaagctggagctgacggcagaggtggaagcccgttataaagcgttaaatcaagggctgtggaaggcgtttgaagagggggaaatgacccgcgatgaagtggtgaatacacggtttgcccttttgtttaaagaatacggccttgaagccgacggcgtgctgatgaatcaggcgtaccgccaatacttagaagaagggcaccagatgatagacggagcttatgagctgattgaacggctgagtcctttatttgatttatacatcgtgacgaacggcgtctcaagatcacaatataagcggctgggcgactccggtctgtatccgttttttaaagatgtgtttgtatctgaggacacgggttttcaaaagccgatgaaggaatactttgattatgtatttgcgagaattcccggtttttctgccgggcacgggcttattatcggcgattcattgagcgcggacataaaaggcggtcagatggcgggaatggatacgtgctggtttaatcccggaaagaaagcaaatgagtccgggattatcccgacgtatgaaattcattcgcttgatgagctgtatgatgtgctgaacgtggaggttgtcgctttatgatttctcaatatatgtataatataatttatatcaagttgtctcgggaaggattattatgaaaaatctttcttcaattagtacaagagtgctcatagagaaaaccattatttgtttttccttatattctattatcagttctatttttaaaacgccaacttttacggcttcggaatccgcttacctgctgattatcaccatttttttagtcgtcaacgatcatatcagattaaaatacctaagcggtcagtattcttttagatattatgcatcttttttagtaagtaaccttttatcaggcattttattgtttaaaattaactgtctcggttctcaaatatataatatttttttactgatcgagattattgtaacaactcgtaaactgccctggactgtagtaagtctgcattttattattttttttacagctcttaaagcagcagggaccagcgggaaagatatattgatgtcctatttagtgatcatggctattatttatctgtttagaaacgtactgctcgaaaaagcaaaaatacaaacattaaataaagaattacaaagtgtaaacactaaacttaagaattattctcaaaaaattcaagagttaactatttctaaagagcggacaagaattgcacaagagcttcatgattccctggggcattatttgatcgcattaacaatgaatcttgaattcgccgataaaatagtaagtaaaaatcccggcgaggctaaacaagtcatcaataagtcacatgatttatcgaaggagtgtattattaacctgagagaagctgtcgctttgctcaatgaccctgctcctcaaaaagggcttctgaaatcgatcaatgagatttttgaaaattttcagcaaacaaatgaaataaaattcgagcttgatatggacaataaagtagagtcagctgatccagatatcaagaattgtctctataaaacagtacaagagtctataaccaacgggataaaacatggaaatgctacgtttttttcaataaaaatacgtaagtcttttgaaaaaatctctatatcgataactgataacggaacaggatgttctgaaattaataagtcaaatggaataaacggaatagaaaaaagatttgccgcacttggaggagaggttgatttttattcagggctagattcaggatttactgtggaagccgtaatccccgagatagcagatctttaatcggaatgtgaggaggtattgatatggatattatcattgtggatgatcagcaaattgtcagggaagggcttaaaatgattctgagtctgcacgaggaaattaatattgtaggcgaagcttctaatggtgaacatttattagatttgctaaaacagataaggcctgaaatcattttaatggatataagaatgcccgtaatggacggcattgaagcaacaaagctagttaaagagagatatccggatattaaagtgattatcctgacaacctttaacgatagtgaatacatttttactggactgaaaagcggtgctgatggttacatactgaaagattctgattcacaagaaattattgattccatcaaaacagcatgtgaaggcaatattctgttaaatcctaaggtaacgctaaaagttgtaaaggctctaaattcggtagaacataataaagagcttgttcaagaaaataatgaaaaggaacagctggtgcaattgcttactcccagagaaaaagaagtcgctaaacagattatggaagggaaaagcaacaaagctataagcgaagcactgtttattactgaaggcacagtcaaaaattatgtatcaagaatactggaaaaacttcaaatgaacaaccgaacggagcttagcttatatttacaaaagcatatgtgattcaacttttttccttcaatcagaaaggaatttcatcaaattcctttcctccattttcttctgaatatatccggacttacaccttccgtatatgactaaagtaacgatgcgattcgtaactaaagtaataaggtaaatgagtactatagtaaattctaaaaatattccattcaggttaaaataaaagaaccgaaataccacgaggggtgttttaattatgcttgaattaaaaaaacttaccaaaaaatatgatgactttacggcagttaataatatttcgctgactgtagaagatggagaagtattcggactattgggtcctaacggtgccggcaaatcaacaatggtttctatgattagcactgttcttgcacctaccagcgggacaattaaagtagataataaatcacttaaggaaaaacctattgagataaaaaaaataatgggggttgttccacaggatttagctttatatgaaacgttaagcgccaaagataacttgaacttcttcggaagcctttacgggctgaaagggaaaaagctaaaagaaagaactgatgaggttctggagattattgaactgacagataaaaaaaatcaaaatgtatcagagttttccgggggaatgaaacgccgggtcaacataggcgtggcgttaatgaataatcctaaattattaattcttgatgagcctactgtaggaattgatccgcaatcaagaaatcatattcttgaaacagtaaaaaggctgaataaagaaaaaggaatgactgttatttataccagccactatatggaagaagtagagtatctttgcgagaaggtggcaattgttgatcatggatctcttattgctttaggaacgaaagaagaactcaaggaaaacttaaatgcttgtgacactttaactgttacttttaagggtgctgatgaagaggcactcagccggataaacagcattacaggaattgataaagtgacggtagatcataaacaaatttcaatgcttgtatcgacgaaggaaagaaacatcattgaaattgtagatgatatcaaaaatctggggatcgacctcactagctttaagtacgaggaagtaaatttggaaagcattttccttcaaattacagggaaaaacctaagagattagtaggaggaggctatcttgagaaaattattcaacttattttttcttgattttaagctgttaacaaaaaataagtcattttatttaaagctgatgctgtttccatcactgctaatcctcatattgggcagtgtgttcagtaattcagattcaaaaatcgaagcatttgatgtagctttttactcagcagattcaggagagagtgtttctttaggtgatgtcttaaaggataaagtttttaagaaaggagatctcaaagatatcattcatttaaaagaagctgagagctacaatgacggtgaaaaattagttaaagaaggaaaggctgcagcttttatctatgtaccggaacactttacgaaagccgttatgaacaacgggaaaacaaatatcgatttaattggagataataataagaccatagataaaaatattgttcaggctgttttggagggctttacgaaaagcgtgaaaacaatgagtgctgagcaacaagaagtaataaaacatatcagccccggcggcagcgtaccaaaagaaaaaatagaaaaaatgatgaacgatttggccgataatgacgggatctccgctgatatcccaaaagcagcgacaaataaaaatgcggttcctgtcgattccatgcagtattattcaattgcaatggttgttatgttttccattatgacggcttttgtgcttgttcatagcattgttgatgagcggcagaataatacgctgttcagaattaaatctacaccgactttaaatattcagtatgtgcttggaaagttgacaggtattatttttgcgatcttaatgcagatgactgctgttattctgataagctgggtcgtattccgaatgaactggggcaacttgtttgatatttttgttattacggtagtatacgcatttgctataggcagcattgtattgttttggggttttaccgctaaggaccacgtggcggtgtccagtatggcttctccggttctttatatttttagttttttgggaggcagttttattcctaagaacggactgcctgatagcttgagggttgtccaagagatcataccgaacggtaaggcaataaactcttatttaaaagtcaaacagaatattggccttagcggcatgtatattgatttgcttgagctaattggtattggtctcatctttgtctttattaatattatggtattcaacaggaagaaggtggcgtagtagtgcaattgattgccatgattaaacatcagctgaagctgatgctccgaaatagattagcaatttttgcaactatttcagtgccgttaatccttacatttttgttctctttttcccaagatacggatagcaaagagaacttgtatatagccaatgctgataaaagcaactatgctgcaaagctcattgaaatgataaaagagcataaaaatattaaagttataaagctaacggaaaatgaaataaagaaaaaagtcgatgatcaggatattccttttggggtcgttattgaaaaaggttttggaaaggaattggcggacaatcacaagataaaaatgaaaatcatccaaaactatgagaacggcagcggaacattgttagagcagctggtcaaaaatgaggcgggaactcttaaaaaggtagttaaagattcgcaatatatgtctgcgcagttgcatacggactcaaaagatatagaaaagaacattttcaagaaattgaaaaacaattcaggaatagaagtgaatgacaaaacattaagccagggtaaacatactcaggataatgcgaccgtgagattaattggttttcttgtaatgtttatttggtttgttgttattcaagggttaagaacacttattgatgaaaaagagaataatactttcagccgattactaagtacgcctataaactatacaaaatatgttttatccaaaatggctgctacttatatttccggaatcattcatataatcgttataatacttgcgggaaaatacttactcaagatcagcataggtcataacatctttgccatcgctgttatgctcgctgtttatttatttgcattgacctgcattacgatgattatggttccatttatgagaagccaaaagcagtttacttctgccgcatcgatcataattgcagtaagcgggatgataggcggttcctttttctcattggaaattgctccaaaatatatgcaggttatttctaaatttacacccgaagcatgggcaatacagtctttaaacaacattatctttagtaagagtaccttaggaactgaatggcttccgatcgtaatttttgcaagtgtcggcttattaagtattattgtatctttcatcttgataagcagggagattaaaaaagaaaattaaatcaacaataatcggataaaattaacagatcaaaaaggacgtgaggaaattgggtatggaagaactatttggaatggctgaattaattataggtgtactcatgaatgtatttatcggtaaaatcgggcaagttgcttttggaaaagataacagaacaacaaggatcattttaagagtaataggaatcttcctcatcatcaacggagtttcaagagcatttcatatataaaatgagatagtaaaaacatccttttcagggtgtttttttatcgggttattacaaaatttctgaggtgaattatgaaaaaaatattttgtcttccgtatgcagggggatcaagtgcaatatactataaatggagaaggttaatgagtgactctttaacaatacatcctattgagttaaaaggaagaggtacaagaattaacgaagatttttatgaacatatagatgaggctgttaatgatatatatgatctgataaaggatcaaatcagggagtgtgattatgctttattcggccacagtatgggaggccgattagtttataagttatattgtaaaattgctgaaatgcagcagaagaagcccaatcacatatttttttccggatgcggcattcctaaaacgaaaaaagcagaggggatgattcatgctttgccggataatttatttttgcaaagaatcatggatatgggcgggacttcggaagaactgttacataacaaggaattacaacaattatatcttcctattttaagaagtgatttcaaaatgttagaaaaggatgttatttctgaaaataagactgttatggactgtgatataacagtgttgcatggtattaatgacaagacgataagctcagatttaatatgtaattggggacattatactttagggaaatgcaatttttatacgtttgaaggaaatcacttttttattcatcaattttcgaatgaaataactgacattataaataaaaccttgagataaattgttgattgaaaaatcgggagtgttactttgtcccggtttttttatgttaatacgaaaaataaaaactgggttaatgtgcttaggtgtttttccctgctaattgacaactcttaaatatttgtataatatttcttaaagatggctagttcttcttcattatcctttttttaaaaaaagtgtttatacgggtctatatcattaaaaaatggtttttgctgccgataaataaactgtcagactacaacaacaattattggtgagcgttattgcctgtgatgcagtttaacataaaaatccaccgaaagcctctgctgttttaattcagtgaatgaattgaattttgatatcaagtgaaggagtttttgttatgacaaaaagtataaagggagataaaaacagtattggtgagttaaaaactgaagagcattttttagtgggaagtaaatcttctaaagaaaaaagaatgaaaaatcttacatataaattgtcacagcaattaagcgataagctgaatgtatgctgcaatggatcggatgaacgtctgcatgtcgtattaacagcggcactgactttgttaataaatcaatatacagaaagacaaaatattgtaatcaagactcctgttttcagaaagaacagaacgattgattctgagcaagaaattttgactcttaaaaatgctgttcatggtgaagacctattaaaagagatcatacataaagtcgaattcaccgtagaacaggcattggaaagcccccaaaataattctcgaacaagtgataaaatgactggccttccttttgatgtcatgatagtccttgaaaatattcaagaatacatacttaatcaagaaaatcccgctattcatatcctattttcgtttataaaccagaaacaatacatagagacagccatacactataacgaatgcctctattctcaaaatatgataaaagatttgtcactgcgatttcagatgatccttgaagctatgataactcctgaaaatatcagagtgaaagatatgagattcctgaaagaaaaaaataagcaaaagaaaatctttggctgggaagataattattcgaaaattggaacaatttcggaggtgtttgagcagcaggctgatgaatattcggataagactgctttggtactagaaaactcttcaatgtgttacgcagaacttaatcaccgtgcgaaccagctggcacggtatcttcaggagtgcggagtaaaacggggagaccttgtcggaattgctttagaacgctcttttgatttgtatattagtattctggcaatattaaagtcaggcggtgcttatgtgccgttagaccctcaatatccgaagcaaagactatcattcttaatcgaagattcaggtgtagagttgctgattacaaacgaaagcattcagtcacaactcccgcctcacggggacggcgtaatctgtttggatggtatgaaagaagaaattgaaaagatggatggatctaatattggcataaaaggttccttggatgacctggcttatgtcatgtatacgtcaggctcaacgggactgcctaaaggagtaagtattgttaaccgcggtgtgattcggctggtgaaggagactgattatgcggtatttgatgagaatcaaacgtttctgcaattagcttctgccgcttttgacgcttctaccttcgagatctggggctgtttattgaatgggggatgtctggctataatgcctccgggaataccgacggctgatgatattgcagaagctgtaaaaaaatataacattacgactctttggctgacggccggtttattttctctagtagttgatcagcagttagaatcattaaaagggcttcagcaattattggtaggcggagatgtggtttccgttccgcatgttcaaaaagtattagcacttggaaaggtacaagtaattaacggatatgggccgacagagggaacgacctttacctgttgtttcccggtccctcatgattggaaaggcagtacgcttcctatagggaggcctatttctggtacagaaatattcattttagattcgcaattaaaaccggtagcgcctggtattcctggtgagctgtttattggcggagatgggctggcgcgagagtattggcgacggcctgatttaacgaaggaacggtttatatcacaccctttcaataatgatccttcagcacgtctttataaaacaggagacttagtgcgttatttagaaaatggcgatgtggagtttatcggacggcgggacgagcaagtcaaaatccgcggttttagaatcgagcttggggagatagaagcccgattgatcaatcatacagaaattaaagaagcggcagtaacagtaaatcataatggtgatgatgatttatatatctgtgcttattacacttcaaatcataaaatcgcaaagattgaattgcagcactttctgagagactttcttccggaatatatggttccatcgtactttaaacaaatggataacatgcctttgacggtaaatgggaaaattgacagacgggcacttcctcgacctgatatatctcaaatgtccgaaacaaaatatgaagcgccgacaaatgaaacggagaaaaaactttcggagatttgggaagctgtacttggcagggaacgcgtcggtatagatgaaaatttctttgaaatcggcggtcattcattaaaggcttctatgttaatttcccgcatcagaaaaacattcggcacggatataaaggtgaaggagctttttgagcagcctaccatcaaacagttgagccgtcttattcaaaagcgggataaacagaattatccggtcatcagtaaagcgagaaagcagtcttcttatcaagcgtcatctgctcagaaaagaatgtttgccctttgggagacggataaagacagtatcgtttataacttgccgattatgattgaactaaacggaaaattagatgtaaaaaaagccgaatcagttctacaagagattattggcagacacgaagctttacggacaagtttcgatgttgtaaacggcgatgtggttcagattattcacgatacatgggagctcgaatttgattatcagaagctgccgtctgatgggatacgaccatatgtgaagcagtttatcagaccctttcatttggacaaagcaccgttaatcagagccggactcataacgtatgaagaccggaatctgctgctgttagatgttcatcatatcgctgcggacggtgtatcggttggaataatccgcaaagaattcaatgcgctgtatgcggatcataaactaaaacagccgccgctgcaatataaagattattcagaatggcaagtaagctcaggaacaaaagaggcgttaaaggaacaagaggagtattggcttaagcggttaagcggagatctgccgattctcaatctgcagactgattacgagcggccgagagtcaaaagctttgaaggaagccgagtcagctttacggccgatgaaaggttaacatcaagcttaaagtcggtggcgaaagaaacaggaacaactttgtacatggtgctgctggcggtatataatatcatgctttcaaaatacagcggtcagcaggatgtgatcatcggaacggcagagtccggaaggtcagacaccgaactggagaatacggtggggatgttcgtcaataccgtcgccataagaaattttcctgaggaacataaaacattcagagcgtttttagaagaggtcaaacatcatacgttaaaagattttgagaatacagattaccaatttgaaaatattgttcaaaaactcggggtaaaaagagattcgagccggaacccgctgtttgatgtcatgtttacttttgagagtaaggattacggattcggaggaaatgaagagacagcagaatcaaatttactggtatctgaggtcaatatatcaagatttgatttaacgttaactgcaatggaaaccgatgaaggcgttaacttccaattggaatattgcaatcatttattcaggaaagacacagtcgaaagaatgggtgctcattatacccggcttttacaacaggttgtatcagaaccggacacggcaatctgcagactgaatatgataacggatgatgagaaacataaactgctttatgtattcaatgatacagcagccgacttcccgcataataagacaatccatcaattgtttgaagaacaagcggaaaagacaccggaaagaatagcggcagtgtatgaaaataataaagtaacttataaagaacttaacgaaagatcaaatagtctggcgagaatactaatgaaaatgggggtgaaaaaagagtcaatagtaggtattgttgctgacaaatcattagagatggtgttaggcatattgggtgtgctgaaggcgggaggcgcatttttgccaattgatccgggatatccttctgagagaatcaaatacatgattgaagacagcggttctgacattttattagtgcagaatagtcaggctgacaatattccgtttgacgggaaggttattgatttaacagatagttctctttacaccggagatcggcataacctgccaatgatgagttccgcagaacatcttgcttatgtcatttatacttctggaacgactggaaaaccaaagggtgtaacgatccggcatatcggaatcagtaatctcaaaagtgtctttgaacatgatatgaatatcaattaccgggataaaattattcaatttgcaagtttttcatttgatgcatcagtgtgggaaatcagtatggcactgttgaccggagcggaactacacatcctttcaagtcaagtcatcaataattatacattatttgaagagtatattaaccggcatgacattactgtagccactttgccgcctgtatacatcaaccatataaatataaacggattatcagctttaaggctcttaattactgctggttctcagatatctacaaaatccttgaaccggatcgtgaataaaatagactatattaatgcctacggtccaactgaaacgacaatctgctctacaatgtggagatactcagaagctgagagggcgatggcaaagaccattcctatcggtaagccgatcagaaatctgaaagccttcataattgatcacaacaacaatcttgtgcctattggtttagcgggagaattgtgtgtgtcgggtgacagcttagcaagaggatatctcaataaagagaaaatgacgcgtgagaagtttattgatcatccatttgagtccggaactaaaatgtaccgaacaggagacttggcaaggtggcttcctgacggaaacatagaatttttggggagaattgataatcaagtcaaaatcagaggcttccggattgaaactgatgaaatagaaagccagcttctgaaaataagcgggataaaagaagcagttgttatagataagtgcgaccttcacggtgacaaatacctttctgcatttgtaaccgcagaatataaaatatccggagcagctttgagggagcaattgggtgacattttgccgcaatatatgattcccggtgtcatcatccaggttgaacagctgcctctcacaccaaatgggaaaattgacaggaaagcacttgcagaaatagaagagcctaaacatataaaggagcaccttgaagcaccccgttccgaagtcgaacagattctggtaaatgtttggtcggaagttctgaaaattgatgatattggtattaatgataattactatgagctgggcggagactcaataaaatctatactgattgtatcaaagcttcaaaaatacagtctcagtctagaggtaaaagatcttttgcagtatccgcaaataaaaaacctcagtaaacacgtgaaattatataaagctcaaacagatcagagcccggttagcgggagaactgaactggcaccgatacaaaagtggtttatagagaatgactttgcggacattcaccactttaatcaggcattcatgtttcaagtgaaagaaaaaattaatgaacacgctctggcaaagacatttgaattattagtaaagcatcatgatgctttgaggttgatatatacagccgaaaatgacgaaataaaacaagaagtcagagatgtccaagccgcccgggatacttttactctggacatatatgatctgcttgctgatacggattacaaaaatacaatagaaaaacttgccgatcagttacaaagcggaatggatcttgaaaaaggacttttaatgaaacttggtttatttcgaacaatgaggggcgattatctacttattgctatacatcatatggtgattgacggagtctcttggagaattctgcttgaagatatggagcaggtctacaacaatctgcaaaaaggagagccggccgttcttccgccaaaaacggcatcctttcaagaatggacacgtaaattggcggaatatgcaaacggaagtgagataagaaaggaacttcggtattgggagaatatcgagaaaacgaagattaaagaaattccgagagatttcaataaaactgacagtgtatttaaggaaagccgcaccattactgtcagtcttacaaagcagttaactgataagctccagaggaatacaaatgcagcttataacacacagattaatgacatcttgctttgttcactgggaatggcagtaaaagaatgggcgggacttgacaaggttttaatcggtctggaaggccacggaagagagaacatattagaaaatatttcaatagaaagaaccatcggctggttcacctcactatttccgatcgtgctggatatggagcacagtgatgatctgccttattgcataaaaaatacgaaagagtatttaagaagaatacctcataaaggtattggttacggaattattaaatacttgacggcaccggcacataaaaaagacatcagttttacgataaagcctgagatcgggtttaactatctgggagaaatctctcaaaaaaagcgggctgtttttcagcatgcagatatatcatctggtacaagtgtttctttatctaataaaaaattgaatgccatcgaaatcaacagctttattatggacggtcaactgcagttggaatttaactatagtacgaaagagtttaaagaagaaacaattaaaacattaaccgaatcctatataaaccggttaatcgatattattcagcattgcggaatgaaaaaaattcctgaaaaaacaccctttgactatggagatctggatttatccatcggagatttggagcagattttatcaagcggaaaagagatagagaaaatccactccctgactcctatgcagagcgggatgctttatcatgcattgcttgatccgttttcacaagcctattttgagcagcttacattttctttatccggtcagcttgatattggcagattaaatacagcttttaatatgctgatcgagaagtatgaaattttaagaacatgcttttttcatgaaggattaagtaagtttaaacaggctgttctaagagagagaaaagttaaaattgaatttgaagatatcagcactttctcggaatatcaaaagaaagtccggcttaaaaatgtccagtttaaagacaggggaacgagattcgatttgacgaatgattgcttaataagagtaaccgtattaaaaactgatgagaaagaatataaactgctgttcagttttcaccatattattatggatggctggtgtatgagtttaataatgaatgatataaaaactatttatacgtcattaaaagaaggaagagagacagtgcttcagcataccgagccttacagcacctacttagaatggctggataatcaggacaaaagtgccgcattagaatattgggggattatctaaatgaatatgagcagcaagccggtattccaaagttctgctgatgagggcggtttcaataataggaagaaaacattcattattgatgaaacatgtacttcgatgttgaaagctgcagctgatcaatatcacattactttaagtgcattgattcagactgcatggggagttcttttgcagaagtataacaacgtggatgatgttgtttttggtgcggttatttccggaagacaatgcagagtgcaaggcatagaaaaaatggtggggttatttatcaatgcggttcctctgagagtaaaaggcgatggtgatacggtatttatagcattagcccaaaagctgaacagtgactttatcaaagcgaatacatcatacggttacagttctttagcggatatacaagctcttacaaagatgaaagagaaactgatcaaccatatgttggtttatgaaaattatcctgttgatgactatggcaaggcggtcgataatacaactgatgctttaaggattacagatatggaagtgtttgaacagacgaactatgactttgggctggttattattccaggcagccaaatcaaagcagagatgacgtataacaataatgtttatcgtgaagatatcattaatcgtataggtgttaatttctgtcatgtgttaaagcaagtggcaactgatcctacgcgtgtcctgaaagacatcagcgctgtaaatgaagaagagcgcggaatgctccaggattttaataagcagtcctctaattatacggtgaataaaacgatacaagacctttttgaagaacgagcggaaaagacacctggccaaacagcggctgtctatgcaggaaagcatatcacttataaagagctaaacgaaaaggcaaatcaagttgcaacattattaatggaaaaagggcaggaaaaaacagcattacggctatgatgatccgtccttcagaatattcaatgattgggatgctgggaattttaaaaaccggaagtgcgtttctgcctattgatgatgaatcaccggtcagtcggataaatcatattttaaaagatagcaaagctgatatcctcattacagatttgtgctttttagctgataaaaacattgcggcggaatgtttggatattacggataaatcgatttataccagccaaaatacatcaaaccctgatgttcagtatgatctcgaggacgaggtatatgttatatatacctcgggtacttcgggaaaaccgaagggggtgaaggtgaaaaataaatcattagttaattattcattatgggtatgtgatcaaataaacataaattctgacagcaggtcgttagtgacgtcaaaatatagttttgacttatgctataccagtatatttccagttttatccggtggcggacaagtccactttgttgataaagaagtgtatcttcactctctatcattaatagaatatattcataaaaatagtattacatatcttaaaatgacacccactttattttcaacattgatggaggatgttgacatgctggcgtcttgtcctgatttaaaagttattatactgggcggcgaaagcataaacatcggcaacgtcaaaaagctcgctgaaaaatgcagatggatgaagtttattaaccattacgggccgaccgaaagcactgttggctgtattgcacatagcattgatctagatcatattcaaaactgtgaaatatacaatagaataggaagaccaattcacggtattaatatctatattgtggatcgttcagatcaactggtccctgtgggagcacctggtgagatttgtatcagcggggtaggtttagcatcgggatatgtcaataatgaagaattaacgaatgaaaaatttattgataatccttttcatcgtggagcaaaaatgtacaaaacaggagaccttggcagatggatgccggatggaaatatagaatttttaggccggattgacaaccagatcaaaattaggggttttagagttgaaatcggagagatcgaaaaccaactattacagctggaaggtataaaagaagcggcggttgtttatatagaggagaaatatctttctgcatatattactggggacattgagatggaaggctcgttcgtacaggagaaattggcacaggttcttccgaagtatatgattccgagtttcataatacaactgaaagagttgcctcttacagctaacggaaaaatcaatcgaaaagagctgcctcttcctgacttgcaacggttgtcagtacctcaatacgaagctccggcaaatgaaacggaagaaaaactagctgaaatttggaaagaaatgcttgggcataaacggatcagtataaatgaagatttcttcgaactgggcggacattctttaacagctgcgttcactatttcccgcatcagaaaaacattcggcacggatataaaggtgaaggagctttttgagcagcctaccatcaaacagttgagccgtcttattcaaaagcgggataaacagaattatccggtcatcagtaaagcgagaaagcagtcttcttatcaagcgtcatctgctcagaaaagaatgtttgccctttgggagacggataaagacagtatcgtttataacttgccgattatgattgaactaaacggaaaattagatgtgaaaaaagccgaatcagttctacaagagattattggcagacacgaagcgttacggacaagtttcgatgttgtaagcggcgatgtggttcagattattcacgatacatgggagctcgaatttaattatcagaagctgccgtctgatgggatacgaccatatgtgaagcagtttatcagaccctttcatttggacaaagcaccgttaatcagagccggactcataacgtatgaagaccggaatctgctgctgttagatgttcatcatatcgctgcggacggtgtatcggttggaataatccgcaaagaattcaatgcgctgtatgcgggtcataaactaaaacagccgccgctgcaatataaagattattcagaatggcaagtaagctcaggaacaaaagaggcgttaaaggaacaagaggagtattggcttaagcggttaagcggagatctgccgattctcaatctgcagactgattacgagcggccgagagtcaaaagctttgaaggaagccgagtcagctttacggccgatgaaaggttaacatcaagcttaaagtcggtggcgaaagaaacaggaacaactttgtacatggtgctgctggcggtatataatatcatgctttcaaaatacagcggtcagcaggatgtgatcatcggaacggcagagtccggaaggtcagacaccgaactggagaatacggtggggatgttcgtcaataccgtcgccataagaaattttcctgaggaacataaaacattcagagcgtttttagaagaggtcaaacatcatacgttaaaagattttgagaatacagattaccaatttgaaaatattgttcaaaaactcggggtaaaaagagattcgagccggaacccgctgtttgatgtcatgtttgtacttgaaaatgcagattacggtattgaaaatcacttggatccaaatccggaagagcatattcaaaccgagatcaatatttcaaaattcgatttaacgttaaccgcgacggaaattgataaaggaattaagttccacttggaatactccagtcaattatttgaaaaagaaacagccgagagaatgggtgcccattttacgaagcttttacaaagtgcagctgccggcctagatcaacctttaatgaaactggatttgattcctgaacaggagaagcacacattgctccatatattcaatgacacggcagctgaatttcctcggaataaaacgattcatcaattatttgaagagcaggcagaaaaaacacctgaacgtattgcggctgtccaagaagatacgctattaacctataaagaactaaacgagaaatcaaacagcctggctaatcttttgagacaaaaaggaattagagaaaacagcattgtcggaatcatgacagagagatctcttgagatgatcatcggaattatcggggtgctgaaagcagggggagcgtatttgccgatagatcctgaatatcctgatgaaagagtaaattacatgctgaaagacagtgatgcaaacattctcctaattcaaaacggattgtcaggtggtattacattcaataaagaaattttatcattaagtgatcctactctatatatgcataacagaagtaatctgccgaatgtcagttgcccggaagaccttgcctacatgatttatacttcagggactacagggctgccgaagggcgtcatggtaaaacataaaggcgtggtaaattatattcattgggcaaataagatatatgtaaatgatgaagatattgattttcctctgtattcttctatttcttttgacttaacggttacttcaatttatacaccgcttatttcaggaaataaaattattatttatgagggaccggacaaggctcttctgatcagaagaattatagaagaaaataaagcggatattattaagctaacgccgacgcatttgagattgctggagaatgtagatttaagtacgtcaaagataaaaaaaataatcgtcggcggggaagagctgaaaaccgggcttgcaaaaaagatacacggtgcatttaacggtcatgtcaaaatctacaatgaatacggcccgacagaggctacagtcgggtgtatgattcatcaatatcatattgaaagagacaatggcaatgcagtatcaataggcaaacctgcggataatactaagctttatatattaggaaaacaattggaattacttcctttaggggcagccggggaactttgtgtcagcggagaaggacttgcagacggatataaaaataaagcgggcttaacgtcagaaaaatttgtagataacccctttgaacccggggctaagttatacagaacaggggatatggcaaaatggatgccggacgggacaattgattatttaggaagaattgatgatcaagtcaaaatcagaggatatcgtattgaaacgggagaaatagaaaaccggcttctgaaaatgagtcacataagagaggctgttgttgtagcgagagatgaccaacatggggataaatatctctgcggttatgttacttccgacaaaaaaatagatgtttatgctttaaaagaaaatctgtctaaagaattaccgttatatatggtgccaagttatatcttccagattgaaaaaatgccgttaagttcaaacggaaaaatagatacgaaatcattgccgattatagatattgcggatgtattggagtctgcatatgaagcaccgcgaaataaaaaggaacaaattctcgcatgcgtatgggagaaagttctggggatgaaatcaatcgggattaactataactattacgagatcggcggagactcaattaaatcaattttagtagtttccgaactccaaaaatacggcttaaaactggaagtcagagatttaatgaaatatccgcacataaaagacttgagtgctcacgtaaaatcagctgatatacaagcagatcagtcgattgtagaaggagacgttgatctgacaccgattcaaaaatggtttatagaacagagatttgaacaagaaaaccactataaccaagcctttatgctttacaaaaagtccggcatagaagaaaaagcaatcgaaacggcctttttggaactggtgaggcatcatgatgccctcaggatgcagtttaaaaaggaaaacggtgaaattaagcaatggaataggggcattaaacaggcaaaagaaacatttactttagaagtatttgatatgacacaaacagaagatccagccatggcaattgaatcactggctgaccgtatgcagaacgaattgagcttggaaaaggggattttaataaaactggcggtatttaaaaccaaaaacggagatcatcttctattaaccattcatcatatgatcattgacggagtatcttggagaatcctattggaagattttgaaacagcttatcttcaaacagttaatgggaacaaggtggagctggaaactaaaacagcatcgttcaaagaatgggcgcgtcaattgaaagaatatgcaaacagcaaggctcttcaaaaggaagctgggtactgggagaccatagaaacggctattattgaacctcttccaaaggatttcattgccgaaagctgctcttatgaagatagtaaagaaattaaaattgaattaacagaggatcaaacaaaaacacttttaagaaatacaaatgcagcatatcatacacaaattaatgatatattgctttgctcactgggacttgcagccaaagaatggaccggcaacgagaagatccttgtgaatcttgaagggcacggccgtgaaagtgttataaaaaccccggtccatcgcacaataggttggtttacgacaatatacccaattgttctcgatatgacggaaagtaatagtttatcaagctccattaagtatacaaaggaaatgcttagacatatccccataacgggattggttacggaatactcagatatttgtcggactcggttcatcttcaattaaaacctgatatcagttttaactacttgggtgaatttggccaagaagatcgcagcaacctatttcaaatatcacctttgtccgccggaacgagcatatctggaagaaataaaaagacacatagtatagaaataaatggatatatcatggatggcaggctgatgtttacgttcaattacagtgcaaaccaatataaacgagagacgattgagcaatttacgaaagcctatcaattgaaaataaatcagatcatagaacattgtgtgaataagaaaatatctgagaaaactccatgggattatggggatcccgatcttcaaatagaggagctaaatcaaattcttgcaagcggtgctgaagtagaaaaaattcattctctttcaccgatgcaggaaggcatgctgtataacgctgtgattgaccatcaatctagcgcttatttcgaacaaagtgaaataacagttgaaggaaatctgaatacagaagttctcagtgacgcattaaacaggctgattgctaaatatgaaatattaagaacgtcatttttctataacggtttccgtgtatttaaacaagccattttaaaagaaagaaaactaaacattcaatatcatgatatcagccaatgggaggagcagaagaaggatgcctttgtagggcaattcaaggtgagagacaggaatactccgtttgatctgaacaaagattgtctgatcagagtatcggtgatcaagctgggaagaaataaatttaaagtcatatacagtttccaccacattattttggatggctggagtgtcggtatcctgttaaaagagcttatggatctatatggtgacgtggctgaagggaaaaaactccttcaagaatcacctgtaccgtacagtcgttatcttgaatggcttgatcagcaggacaaggaccgtgcatttgaatattggaaggaatatctttctgcatatgaacaagagatctcatttccggaactggaattgaaatctgacgagtatcagcatgatcaaaaactgggagcgcttaacggtgaaaccgccgctaagctgaaaaaaatcgctgagtcaaacagcattacattaaattctatcgttcaaacagcatgggggatattgcttcagaaatataacaatacaaatgatgtggtatttggttccattgtttcaggcagaccgagtgagataaacggaattgaaaatatggtcggcttatttataaatgcagtgccaatcagagtgaaaagagaatgtgatacatcatttatttcattggctaaacaaataaataaagactttattgaagcgaacgaatacagttattgttctctggcagacatacagtctttgacaagtatgaagaataaattaatcaatcacgtagtcgtgtatgaaaattacccgttgagtgaggatcttttccaagattcagcccgttcgagtgtaaaaataactgctgaacatgggtttgaacaaaccaactatgatttagagcttttaattgctcccggtgacgacttgcatatgaaaatcacatataacgccagtgtttacagtaaagaaacggtaagttcaatcttagataacctggttagcatcttacagcaggcagcggctgatcatgaagtaatagtttctcagatcgatatggtaaatgagacagagaaacaaaagctggtgaaagaattcaactgcacggaattatcatataagaaagaaaagacgttacaagagctcttcgaagagcaagctttaaggacacctgatgcaatcgctctggaatggaacggagacttcttgacctataaggagctgaataataaggcaaatcaattggcaagagccctcagggaaaacggcatcaaagagaatgttgtggttcctattttggtaagaaggtctttccgattgattataggaatattaggaatactaaaggcagggggatgctacttaccgcttgatcctgattatccggcagacaggatcaattatatgctgaaagacagtaaaagcggcctgctgttaactgaagaaggacttccaaatgaattaacgtacagcggaaccatatttaacatagattcagaggatttattacatcagttggagacgaacattgatgttattaacagggccgaagatttagcatatgtcatttatacgtcgggatcaaccggaaaaccgaaaggggtcgccgtagagcaccgtgccgttcataactttattaagggaataacagacaggatcagcttttcacaagacaatgtccttctttcggtcaccacgtgctcatttgacatattcggattagagtcgctgctgcctttaactcaagggctgaaagttgtcatagccggtgaagcggaacaaagagatccgtacttgttaaacaagatcgttgttgagactgatgtcaatactattcagcttacgccatccagattaaagctgatgctaagtgcagaaaacagtacggagagtcttcagaaattgaagaccatcatggttgggggcgaggtatttcaacgggaattgttatttgagctaaaaaaatataaaaatctgaagatctataatatgtacggtccgactgagacgacgatttggtcttctgtgaaagacttaaccaatgaaaatagtgtaaatataggcaagccgattgcgaatacacagatatatatagtagatcatgatggaaacactgtaccgctcggcagtactggcgaattatgcattgctggagccggaatggccagaggatatttaggaaaagaagatttgactgcgcaaaagtttgtagacaatccgtttgttaaaggaaccaagatgtataagacaggagatttagcaaggtggctgccaaatggtgaactggacgttatcggaagaatggacaatcaggtaaagatcagagggtatcggatagaattgggagagattgaaagcatagtaaaccaacatgaaaaagttaaggaatgtgtagctgccggaaaaacaaattccgcaggagtccaagatttagttctgtattatgtggcagaaagcactgtatatccttcagaatttattaagttattatcacctgtgcttcctgagtatatgattccgcagatctttatgaaaattgaccaaattccgctgacagcaaacggaaaaataaatgtcctggcactgcctgaacctgttatagatagaacaggttttgaccggccttttgaggaagcggtaacggatgtacaaaaaagtatcagccgtgtttggaccgatgttttaaaaatagaagagcctggaatacatgataacttctttgaagcaggcggtaattcaatcaaaatcgttgcagtttataatgagcttcagaagctgtatccaaaacaaattcaaattgctgacttgtttgcatatccgactatttacagattgtccgaatatatagaatcagctatagcctttgcggagatagcagtgtccttggaaaaagaaatcattcctattactttaccgcttgaatacatctcggaatcaactggacaaagtcatacagccatgcacgaatatgcggtaaatgcgaattattatgatggtttaaaaacaatatgcaatacctacaaatatgatatttctcatgttttattagcgggttatgtatttttattagctgatgtcagccagcaaaacttggttcatatccaattttcgggtcatggagatgatcggatgagtcagctgtcttttgatctgtctgatatcgagaattttcacgatattattcgtatggcgaaggagcagattgagaatcaagaggattcacaatacgatttgaatactcactataagaaatcaagttcggcccaagatgtttttcctcttttttatattagtaatgaatcaaaaaaagagtactcagaattatatgatctggtttttgcagttcatgaaaagccatccgaagcagaaatcgtttttatatataaccatcagaaactaaatgagcacaaaatgaaagatttattttataactacatgaatttgattcaagtgattacagcagacaaagcagacaattcaatataaagcggccggttctgccttacattttgctgatcggcagaatgtaaggcaaatcaggcattatagggactttggaggtatttaaatgtcgaaaataggttttttattttcaggacaaggatctcaatatgcaggaatgggcaaacgtttatgtgacaattttattatcgctaaaaaaacgtatgacgaagccagtgatgcattgggatttgacctgaagaaattatgtatagatggaagtgccgctgagctatctcaaacagaaaatactcagccggccatcctggcaacaagtattgcacaattcagaatctacatggaagaggtcggaaaagaacctgaatatatcgccggccatagtttaggagaatattctgccttggtttgcagtgacgttttggatttccaggacgctgtaaagctggtgagagccagaggattattaatgaaagaagctgccgaacaagggaccggagcaatggctgttatcaggaacctggatgaaagaatagcagaagaagagtgcgaatctctctcttcaagaggaaaaacgattgctgtttctaactacaatggatataaagatgttgtggtatccggagaagcggcagcagttgaagagcttagtgaaactcttaaagccagaggagcagacatttttaaattaaatgtaagtgctgcttttcattctccgatcatgggttttgctgcggaaaaattcagccatgagttaaaaaagtatgatctcagaactccaaaatacaaagttttatctaatgtgacggctcttccatattcagataaacagcaaatggctgacatactgggaactcaaatcgtaaaaccggtaaattggatgggaatcatgaagtatttagaagcaaatcatactgatactgtgattgaatttgggccgaaatctgtattaaggaatcttgtaagaaacaatatcgctgacatcaaatcgtacagctacgacaaagaagaggacgtgaagattataaaagagactcttttgaacgaatctgtttcactgcaagccggtttttctattatctcgagaagtttagggatcgcggttgctactaaaaattacaactggaacaatgaggaatacgccaaaggtgtaatcgaaccatatgaaaaagtagctgccatacaggctgaacttgaaacatcaggtcgtcagccgtcaagagaacaaatgcatatggcagtagaaatgctgaagtcagtgtttcgaacaaaaaaaacccctataaatgaacagaaaaaaagatttaatcaattattttctgaaacaaacacaaaaaaacactttgaagactttgaagtttgacaggtatgatcacctatctagtgattctcagcgaggtaaaaaaatgaaaacagactttataagtttaagtaacttaaaagcggccgcttttacaaatcaaactcctaatgtaaagaaacaaaaaaacgaggaagggaccaaagacatttccggagatgacattgccattgtcggtttatcatgcagaatcggcgaagccaatcacgtaaatgaatattgggatttacttttacaaggaaaagagttcatcagagacattcctctgaacagaaaaaaagatgctgaccagtcattaaaaaacagcggaaccaagtacagtaaagatgcagcctatacaaaaatagcctatatggatgagattgataaatttgattgtgactttttcagtatccttccaaatgaagcaaagttgattgatcccagacaaagattatttattgaaacggcctggaacgcattggaagacgggggttacggcggcggaaaattatgtgggacaaatacgggagtatacattggactcagcagtgacggctcaaatgaatacttcagattgcttgaaaaaggagatcaatcattactcggactggctaccgcgggtaacattaaatcagttatcgcaagcagactgtcatatatcttggattttaaagggccagcaatggtaatcgatactgcatgctcttcatcgcttgtcgccctccatacggcttgtcaggcaataagaaataaggattgcgatatggcattagccggcggagtgaatataaaagtattcccaaagacaatagaggagagcaggttaaatatcgggaattcttcatctgattttgctgtaaggactttcgatgattctgctgacggcacgaatagcggcgaaggagtcgctgccgtattgctgaagccgctggcccaagcgattcgtgatcatgaccagatctatgcagtcattaaggggagcgctgttaatcaggacggcagctcagtaggaattaccgctcctaacgcagcagctcaagaacaagtaatagtagatgcgtggaaaaatgcaaaaatagatcctaaaacaattacatatattgaagctcatgggacagggaccaaattaggggatccgattgaaataaatgcgttacaacgggctttcagaaaatatacagaccgaaaacagttctgtgcagtatcttcagtcaaaacaaacatcgggcatcttgatagtttggcgggaatagcgggtttaattaaagcggtaatggcattaaagcataaaaaaattccgccaagtttacattttaaagtgccgaaccgaaatatcaattttcatgaatcgcctgtttacgtcaatgactccgtttcagcatgggagagcagcggagtatacaggtgcggcatcagcagttttgggctgagcggtacaaactgtcatgtcattttagaagaggcacccgcagttgaaaaagtcgatcaatccgttttatctgaacatatttttactgtatcagctaggactaaaacatctctcgcgcacttgcttacagatcatattgattatttaaagagagaaacagatgtgaatctgggagatatatgttatacagcaaacactgggagattgccaaacaaatacagactcgctatggtaataagctctgtcgcggaactgctggaaaagctggagtttttatcatgctctgaatggaaaacgtatcgggagaaaaatatatactttcaatcgataacaaatcaaacaaagtttataggaaaaacgcatacagacagtgtgcagaatactcaaacaataaaaaatgtgattcaaagagtcagacaagacgtctctaatattccaacctctgacttacatattttatgtgaaatgtattgtgatggggcgaatattaactttgaagatctttatagcgagatgaattttcaaaaggtcagcttgccgacatacaaattcagcggaaaaagattatgggctgagctggctgcagacggcccttcagccgatgagaaaaaacaatctttattgagcaatcttgcagtgcagtcactgaatctggaagtgtatatatcccatttgaatgtcactgattattggtttttaaatgaacataaagtgaatgattcttacgttatccctggaacggtttatatagaaacagctagagaagcgggaagaaaatacttcggcgaacctgtcggcattctgttaaaagacgttacgttttcaaatcagttaaaggtaaaagcaaatgaagttaaagaagttcatacgatcataaagaaaaaggacagcgttttagagtttagtgtgataagtaagaccggcgataaatggataaaacacgcggaagcggtcattgcgaaagaagaaccggtacgggaaacatatgacattgaggatttaaagaaaagctttaattctgtttatgtcattcaacgtaataatcatccattgacggaaataaacaccgatgaatacaagtcggtttatcatatagaagataccaatagaccggaaagcatcgttcaagtcggaggcagatggaaatgcaccaacgcaatctacagagacgacgacaggcttctatgtgaattggaattgccgaaagaatatgagagtgatttcgttcagttttcgcttcatcctgcgatgatggattgtgccgttaatgccgggacattcacaatagataacgaaacctatctcccttatttttataaagaatttaagatttatggctctgcttctaaaaagttttacagttatatcaagaaaaagagccgaagcaacggggaaacaggaacgtttcgcatcgtcctgctgaatgacactggagaagttttcggtgaaatcaacaattacatcgtaaaaagggtgcataaagcagctgaaaagactaaaagaaacaatatatatcataagctatcttggataagagaaagcgatcaatcacacgagatgcgagaaattcatcatcctattttattatttaagaataatggctgcagtttatccgaggaaatcattcgaaggttagaactggaagggaaaactgtgattgtcgcggaacagggtgactatttctctaaaatcggaagccatcattatactgtcagtgattctcaagaagattatgactgtcttgtaaaagctcttcaaagtgaaaaggtttctcagattgtccatttgatgtctatcagcaatgagaaagacaaaaacatatatcagcttcagaaaaaaatatcctcaggggtagacagtttattttatttaacaaaatcacttgtagaaaatacaaaaaataacatagaactgatgctgtttgcagaccttgcacatcaagtaagcggtgaagaaccagacattaacccgcataacgcggcatttttcggttttggaaaagtaattgaaaaggaatattcgcgtgtaagtgtcagatgcatagatttggatcaaaatcttatggcggaaagcatcttgtttgaaatcaactcaaaaaaacagtcagagcttgtcgcttacagagaccggcataaatacgttcaagagctccagactgaagacttatccgtaattcgggaagggaaaataagcatcagaaagaacggtgtatatgttattaccggcggtatgggcggactgggattagaaatggccaagtatttatcatcaaaagaaaatgtccaattaatcctcattggacgctccgagcagcagatcaacatggagaagggaaacaacaagaaaatcgatgctctaaaagaaataaaagaaagcggttctaaggtagattactataaggcggatgtcgcaaatgaaagtgaaatgattcatgtattcgaggaaataaagagtaaatacaatacaatccacggtgtcatacatagtgctggtgtttctggagatgggtttattttcagaaaggaaaaaaaagtgtttgataacgtgctcagaccgaaagttaatggaacatggatattaaacgagctgacaaagcatgagcatctggatttcttcataatgttttcttctatcacagcacttgcggggagtatggggcaggctgattatactgcggctaatgcctacctggattcctttgcagaacgcagacagcgaagaagaccggatgaaaaaacagttacgattaattggtgcggctggtcggatgtgggcatgcttgccgaatatattgaagagcgtcaaaaggccggaaacgaacataaagatgaaaacggctttaagacgattacctcagctgaagcgatacgtgccttcgatgaagtcatgcaaaaggacatccggaatgtgatcatcggggaaattgatcatcgggtactggaattaaatcaagatcaaattcatttccgattatctccggatattttgacttttaaggagcaggcgattgtaaaaaaatctgttgagtcgaaaaccgatcagacatttagcttcagcgatattgaaaataaactaatgaaagcttggataaaagttttaggcttagaacaaatcagtataactgataaattttatgatttgggcggagattcaatatccgcgatatatctggtaaaagaaatagagaaagaatggccttctctcattgatgtttctgatatttttacgtatccctccattaaggagatgtcaacctaccttgaatcccacttcagtgatcagaagtcttctgaccgaatccctgaagaagacaatgaagatgacctggatgcaattttgaataagctggcatccggagagatggaagtcagcgaagcaaatcaaatatttcatccagaccgaaaataactgaattgggcctgtaagaatatattcgcaaaatggatattggcaggctgcgaattgaatgaagaaaaagcagcctgcctatcctatcacattattacgggaactgaattccattttaaggtaaaaatgtagatcttattacccttcctatcaaaaattttcttagaaagaaagcgggagtgatccgtaatgaatagcgttcaatcttatatatttgaacaagtgaaacagcataagctaagccagaaagaagcaaagcgaatgctaaaagaattaaaggctgcaagcagcaatgaagatattgctatcattggaatttcctgcagactgccgaaagcaaacaatacagatgaatactggcagaatctgatgaatggagaagactgcaaagcggaatatccaaaagatatgatcaattacattaaaccgatcgtaaacaataaagggtttactgattttctcggttcaggatatctgacggaagaacaagcagataactggaaacctggcggatatttagaagacgtagacaagttcgatcctgaattttttaatatttctcctaaagaagcaaaggccattgacccgtctcacagagtattgctggagacggtatggactgcgattgaagatgcagggtatgcaggggacaaaatttatggaagcaacacatcgctctttgttggaaaagaccatgtcaataatacgttgtaccgctacattacagaatcagaatcgacaagtatgacgggcaactggccgggtttgatggcggggcggattaattatttattaaatttaaaaggaagttctatggttttggattctgcttgcagctcggggctgcttggtgtgcatcttgcctgtaatgctttgaaaaataaagaatgcgatatgtctattgtcagcggaatttcattaggattctttccgcgcttcaaaacgtccaaaaaatcaatgatggaatcagtaagtgataaagtacactcatttgataaagacgcagacgggacatttttcagtgacggagtagctgcagtcatcttaaaacctttaagtaaagccaagcaggacggagatcatatttatgctgttatcaaagggagtgcagttaataatgacggggcctcaaatggattgacagctccaaatgccatcgcccaggaagaagtactggttcaggcatgggaaaatgctcaaattgatcccgaaaccattcaatatatcgaagcgcacggtacaggcacaaagcttggagatccaattgaaataaaggggatttccaatgcgttttcaaaatatacggacaagctgcagttttgcgggatcggatctgttaaatctaatattggccataccgttgccgtttcgggtttggcgtcacttatcaagatcgttctgtctatgaagcatcaagtcatccctccgagtattaattttaaagaaccgaattcattgattaactttgtgaagtcacctgtatttgttacagacaaagcccatgaatggcctaaaaataactcaccgaggagagcgggaatcagttctttcggctttgtggggaccaattcacatgtagtgattgaagatgctggagatgaggttgaagaggtcattcctgcaaatgaaacatttgagatatttactttatcagctaaaacagagaattctttaatgaaactcatcaaggaatataatgaattctttaaaaaaggaactcaaaaaaacgtaaaacatatttgctatacagcaaacacagggcggggccattacggctaccgattggctctgattgtaaaaagttacgaagaattaaagagaaaaatcggcaggcttgcagggcataacctgaatgaaatatcagaaaaaggcgtatatttttctttccataaagttggttctgatagaaaacagattatggatgaaggagaaatttccttatctgaacatcgcaaaatgaatgctcaatctgacaatttgatacatgacattcttactgaaggggatgaatatttactgctaaaccttacggaaatttgcaacctgtatgtcagaggagcaaaagtagaatggacaaaaatgtacaaggatgagcgcagaaagattgtcagtcttccgacataccaatttgaaagaacattatgctggggagaagtaaaagacagaagaggtcaagcgccgcatcagaaaaatatcagtcacccgctgattgaccagtgtttggctgattcaatgaatgagacgatctattcaacgacatttaatgtgaataaggattgggttttaagtgaccataaaatcatgggggcttgcgttattccgggaacgacttatatcgaaatgggaagaagagcaagtgccgcttactataaaagcaatcaattagaattacgagatattatcttcttcactccgttaacagtaaatgaggatgagaataagattgtacacacaatcattaagaaaaagaaagaatgtattcaatttataatagccagtcaggaaggagaaacctggattacacatgcagaaggaaaagcgtttccattaacagactctgtatcaatgtttgatttagactctgttaggaatgacagtaatagagagaagataaaagtcaattatgaaaataaaaatggtttaatcagcaaagtctttactttcggaccgaggtggctgaacttcaaagaagtcatactgggccctgatgaacaattggccgaattaaaattggctgatgaatttacagcagatttaaaagacgtctttttacatcccgctttgctagataatgcagtgaacgtgtttattggagaagatgatgacgatagtacattccttcctttttcatataaaagcgtgaagatttactcaagaatgccgcagcatttttatgcatttgtcaaaaagaacgcaagcagtaaagagacaaagctgtgtgatattcagttaatagatacagaaggaaatgtttttgcagaaatcaccgattatgtattaaaaaaagtaaatcggattaatgccctttttgaagaaagttctgaatcactttatcaattaaaatggatggcgcaagaagcttttgaagaagaaaaaacagaggtaacaggtcctatactgttatttaaagacaacatggaaatttataaatctatactggaacagttgaaaattcatgacgatgatgttattgaagtggagtttggggatgaatttcagaagataaatgggcggaaattcctaattagcggatcagaagaagactatgttcaattattgcatagcataaacgatcaaaatatcagcagcattatacatatgtcttctatcagccgccaaggaacggaatcattaacagatttagaagacatgcagaataaaggcgtatacagcctgttccgcttagtccggggattaagtaagaataagatgaaaagcaatattaatttgcatcttatttctgatcttgtgacagaagtgtccggagaagaaaatacaatcaatccattgggcgccgcgttgtttggtctgggacgtgttatttcgcaggagttccaaaatgtttcatgtaaagcaattgatattgatgaacatacttcaccggaaattattagtgaggagttaagaacaaaagggaaacactatcaagtcgcctttagggatggtaagcggtatatcagtcggttggatacggttgaaccgataaaggataagaaacacggcggtatggagattaaagaaaacggtgtctatatgattaccggcggcaccggcggaatcggtttggagatcgcaaagcacctggctggaaaacataacgtcaatgctgtattgctcaatcgctctaaactgcctgatcaaagccgatgggacgatatcattgctgatggaacggatttaaagctttgcagaaaactgaagtccatcagagctatcgagtcaatgggttctaaagttgattgctacagctgtgaagtttctgacttaaacagcatggagccggtaattgaagaaataaaacagaaatacggtacgatcaatggcgttttccattgtgccggagttgccggggacggtttcctctttagaaaagaagctaatatttttaaagaagtgctcgctcctaaaattaatggaacatgggttatcaatcatttaacgagagacgtagatttagatttcacgattttgttctcctcaattaattctattttcggaggtgccggacagggagattatacagctgcaaatgcttatttagattcctttgcttatatgcaaaacaaacaggggaaaaacacgctgtcaattaactggccggcttgggatgaggtcggcatagctgtcgattatggaattactgatgagagctctattttcagattattgacggtagaaagggctatttccgttttagaagaaatagcatcgaataagcttactaatatcattccaggtacattaaatatgaagctcctcgcttttgcgaaggatgaattgtcttttgaattatctgagcaaatcaaaaacaaattaatagataaaaacaggacaaaaaacgaagcagaaaaacgtcgaagaacagatactgaagatatagtgctgaaaggaaagggagaactttactctgataccgaaaaaagtattgcgcaaatgtactctatggttttggatatgcaagagctggatttatatgaaagctttagtgccatgggcggcgattctattatggcaacccaactgttaaaactgataaatcaacaatatcctgacattgtggatatatccgatatatttacatattcctctgtagtggagctatcagagtatattgacaagcagctgaataaagatcatcagcaagaaacggaagaagatactgctgaaaatcggcttgagcaagaactcaacaatctatttgacgacctggagaacggcaaaatcaatatacaagaaggattgaaaattctagaaaactagtttcggaaaaggggaaaattaatgaagaatacagaagaaaacaagactgcaatcataatcggaggcggtattgcaggaatggccgcgggctgttacttgcaaatgaacggatacagcacgaaaatttttgaaatgggcttgctgccgggtggtttatgtaccggctggaagagaaaagggtacttttttgacggttgtatcagctggctggtcggttcaggacctaacaataccttccataaattttggaaagaactgaatgtaatacaaaatatggaattcattaatgatgaagaatttgcggttgttaactttagaaatggtgatacatttacgctgtatgctgatgtagataaattagaacaggagtttttaagagttgcacctgaagatgcggaaacaattaagcttttaactgatggcattcgagttgtttctgatgtagagctggatttggataaagcgcccgaactgttcgatttagcagactttgaggccttcaaagcaaaggctggcccttacatgaaagtaatggggcaatggggaaaagtgacgatcaaagaattcgcccagcgctttaaaagcagttttgtaagagaaaatgtaaatcgtctgttttggtttaatgtagatacccctatatcttactttatggctactttaggctgggctaatagcaaatcttcaggacatcctgtagaaggttctctgcaattcgcaaaaattattgaagccagatatgttgaattaggcggtgagattcaatataaatcacctgtttctaaggttttagtagaaaatgataaagcgatcggaatagagctgaaaaacggacagtgtcattatggagatatcgtcatttcagcagcggatggctataaaactatttttgaaatgctggatggaaaatatacagatgatgaactgacattttgttatgacaaccttaaaacaagtgcaccgcaaatttatgtcggattgggcgtatcaaaaacgtttgaaaaatatcctcattatttgagtctggaattagaacagcctcttaacgcctatggctgtgacaacgttaaaaacatatttgtgaaaatatataacgaaaatccttcattcgcgcctgatggcaaaacgagtattatcgtgtatgcgaaaacttctgctgaatactgggagactttgcaaaaaaacaaccgcgaaaaatatgaagaagagaaaaaagcaattgcgaatgtaatgattgatgaattagacaaatggtttggtgaaattaaatcaaatattgacgtgactgatgtatccaccccatatacgatcagaagatacacaaataatagaaatggaagctggcagggctgggaaaaacagatggaaggcatcatgcacgagaaaaaactgaaacgttcacttcccggacttaaagacttttatatggttgggcattggagtcaagtgggaggaggtcttccgagtgttgtcttacaggccagaaatctggtgcaggtgttatgtaaagaagatggaaaggtttttgagacaaaaattaactaattcaataagctgcttcaattgaagcagctattctatatatccatgatgcttctcatattttatatagaatcaaaatcgataggggtgattaatcgtggatgatatttcgattataaaacaatatgtattggagcaagtaaaagagcaaaaaatggacagggaaatggctttgcgcattttaaaaggattatctgataagtccaagaaaaatcaatttgatattgccattatcggcatatcctgccgtttctcaaaagccaataatgcaaaagaatactggcaaaacattatgaaccgtgcctcatgcatccgggacttaccggagaagcggcggaaagatattgatccattgctgcccagtgcgaatgagaattcttattttagagcgggattcttagatgaaattgataagtttgattcatcatttttcagaatttcgccaagagaagccatgcttatggatccgaaacaaagattgtttttggagacagtttatcacgctattgaggactccggttatgcggggaacaagttacaaggttcgaatacaggtattttcgttggacatgatcatagcggtgacttgaagttttcctatgcttccctagtaaaggatgcggatatgattgcaatgacaggtacttatcccggcatattggcaagcaggacctcctacatttttaatctgaaagggccaagcttggttgttgatacagcctgctcttccggactcgtttcggttcatcttgcttgtgaggcacttaaaaatgaagaatgcagcatggctattgcgggaggcgttaatttatttctgagacctgaaaatataggtacgatgagcgaaatagaagcggaaaacgctaaaatcagcatttttgataaaaatgcaaaggggaccgcatggggtgaggggatttctgctattgtattaaaacctttacatagggctatagaagacagagaccacatatatgctgtcattaaagggagcgctacgaataatgacggggcttctaacggaatcactgctcctaatgctgaatcacaagagaaattgatttcacgtgcctggaagaatgcgaatattagtccggaaactatttcttatattgaaacacatggaacaggcacgattttgggagaccccattgagatcaaagggataacgaatgcgtttaagaaatataccgataaaaagcagttttgcggtataggttcagtcaaacccaatatcggccatacagtcggggcatcaggcatggcgtctctcattaaagcatgcatggctttaaaagagaaggtcatccccccaagtatcaactttaatgaaccgaatcctttaattaatttttcgaattcacctgtttatgtgaatgacatgataagaaattgggaaaaaggagagacgccaagaagagccggtgtaagttcgtttggcttcagcggaaccaactgtcatattgtattggaagaagcacctgaaataataggtgagactgaacagagacaggtaaaagaggtattcactctgtctgcaaaaaataagtccgtcctgaatgatatagcatcaaagtatcttcattttatctcggaagaaaacaatttgaatctctctgatctttgttatacagcgaatacgggaagaaaacatctggagaatagagtgtgttttctcgtaaaagacatcgaagatctgaaggaaaaacttgaaagtctgctcgaagcgccggttcagcaagaagaagctgcattttcttataagaccgatagagatctaagtaccgctgctggaaaaaaacttaaggcttataatgcaggcgggagaacagatgagagtcttctgattgatataagcaagctctatgaaaaaggtgcagagatcgattgggaaatgttatatgaaggagaaaaaagaagaaaaatcagcttgccgggttacgcatttttgcgggagagacattgggtgaaactgcctgaaaaattaccgataagcaatgcaccagataacccttcagtcaacaagcctcaaataataagactgagtggcagggaagacggctgttattcagaaacagagctaatggcaggacaaatttggggaaatgcccttggaatcaatccgatcgatgttacatccgatttttatgaaatgggcggagattcaatcatagcaatagaaatcatcaactttatcaataaacagcaaggaacggagctttcagtttcagacttgctaaagcattcgaatataaaactcttctcagcttatttggatgaatattctctgaggaagacaaatgatgtgaatgtgattcccaaagcaggcgatttagagtggtatgaggcctcatctgcacagaaaagaatttttattctagatcaattaaataaaaacagcacttcttataatatcccgttctttttaatgattgaaggagagttggacgataaacgtttagaagatgcgtttaaaaaattaataatcaggcatgaggttttaagaacgtccataggtttaagggacgggcagcttgtgcaaatcatagaaaaagacgtccgatttaaaatggatagaatcaagacctccgaagaagaattagagagccttatgtctaattttgtccgcccgtttgatgtagaaaaggctcctttactgcgtgcaggattagccgagattagtcatcaaaaacatcttttaatgatagatttacagcatattatagcggatggggcgtctatcccgatcttccaaagggaattgataaatttatacgaaggcaacgaactgccgtcattgaacattcaatttaaggattttgcgatatggcaaaatgaattatttcatactgaagaaatgaaaaaacaaaaagatttttggttaaatgagtttaaaggagaaattcccgttctcaatctgcccgcagatttttcaagagaagccgaacgagatgatcaaggtgaacgaatctatttttatgcaggaagagagctgactgccaagttaacagaattaaacgcaaaacaaaaagtcacccttttcatgactttaatggcttcatttaatgtgcttctccataaacttactggtcaagaagatattattatcggcacacctgtagccggaagaaagcataaagaattagaaaacatgataggaatgtttgtaaatacgctggcactgagaaataaaccatctgccgacaaaacattcaaagaactgcttgaagccgttagggataatgcgcttctagcttatgaaaatcaagattatccttttgaagagcttgtagaccatttgaaccttgagagggatataaaccagaatgctcttttcaacgttatgtttgtccttcagctgatggataatccggcaattgaagtaaatgggctgaaatataagccgtatctttatgaaaacaaaacagccaaatttgatcttctgcttcaagcatttccttcaaaagaggatatcaagtttgagttcacttattcatcaaacttgtttaagcgcacaactgtagaaaaattctcacagcgattcttaatgatcctcaatcatattgttgaaagtcaagatggactaatcggggagattaacattttagaagaaaatgaacgacgcgaaatattgagttacagtggaagatcactgagaagcagaggcacagatgcatctatctgtgagctttttgagaagcaggcggaagcaacgccgaatcaaatagctgtgtctgcacaagacggaagcttaacttatagtgagctgaacaaaaatgcaaaccggcttggaagagcactcattcaaaaaggtgtcaaaaagaatgaagcagtaggcatagctgcagaccgaaccactgattttatcatcggaataatgggaattttaaaagcaggagcagcttatctgccaattgatccatcatatccgcaagaaagagttgagtatatgctcaaagacagcggggcccgtttgttactgacggatcgcaacaatcatggtcaaaggtacggagtagaaagtgtttgtctgaatgaattggaaacagttccagacgacgggaggaatgttaaaggaggaacggaagggcatagccttgcctatatcatctacacttctggatcaacgggacacccaaaaggtgtgatgatcgaacataaaagtatagcgaatttaacagaagccctgcatgaacgtatctactgcaaacatggcgggcagcagaatgtagcgttgttggcacccttttcttttgacgcttctgtcaaacagattttttctgcactgcttttaggacactctctttacatcgtctctgaagaagccaggcatgatatcacgaaacttgctgaattctatatccaaaataaaataactatttctgatggaacaccagcctatctcagcctgctctctgagtctccgcagtgtggccgtataggtgtaaaacattttattataggcggcgaagtgcttaaacctgaagaagtaaagcgtttctataaagtatttaaaaagaatgaccgtccttatataacaaatgtatatggaccgacggaatgctgtgttgatgctgcagcttatacgataaaccaggataatatttccaatataaagagaatccctatcggcacaccgataaaaaactgttctatctacatactagataaacagcagaagcctgtgccgccgggagttatcggagagttatacatcggaggggaaggagttggacgaggctattgcaatcgtgaagaactaaccaaggctaaatttatcccggatcttgttcattctggtgagaaaatgtataaaaccggagatttaggcaagtggaatgaggatgggaatatagaatttgccggaagaatcgaccgacaagtaaaaatcagaggatttagaattgaactggatgagattataaacagactgctgtctcaccgcaatgttcaagaagcggttgcgattgctcacaatgatcagatatatgcctatacagtatgtaaagatacgcagccgccttctcagctaaaagaatacttattggaatatctgccggaatatatgatcccgacagtcattattggcatagataaaattccgttgacgaacaatgggaagactgatgtaaaacgtttgccgcttccagctgaaaataatgccgagctgcatcactttattgctccgagaaacgagattgaacgaatcgtcagtgaggtttggtccgacattcttgaagtttctaaaatcagtataaaagataactttttcgttttaggcggagattcaattaaagccatacaagcagcggtcagaatggaaaaattcaatcttaggctggaagtgaaagacatctttcattaccagacaatcgaaggagtttcgaataaagtcagttatataacagcggcatctgataacagtgtgataacgggagaagcccgtcttgtgccaattcaatgctggctggctgaaagccataatgatactctgcaccatcggaatctttcttttatgttatacagggaagccgggtttggcgaagatattgtaaaagacattttcacccggattattcagcatcatgacagtctgagaacagtattcaaacgtaaaggcgatagaatggtacaggtaatcagaggcctgacggacggcgacttgtttgactttcatctgatcaatgcaataaacatgccgcaatcagttttaaaaatgaaaataaatcaaatacaagccagtatggatctgactcacggcccgcttgttaaattggcactcattaaggaagcagatggggaacatctgttaatcgtcattcaccaaatgatcattgatcatatgtcttggagaatactgcttgaagattttaatacagcatatcagcaagttaaaagtaacgaagacattgtattaccaaataaaaccgattcgtatttaaaatggtctgattatctctataaatatgctgaaagtgaacggctgttgtttgagaaagagtattggacgaaaatcgaaaatgtttatgctccgtctattccggttgatattcaggggcaaattgccaaagtcaaagataacagacaagtgtacaggcagtttaatgttcgggaaactgaaaatataatgaatgcgattcaaggacaagatcatttcactattgagactgttttgctcacagctttaggtttgacagtaaaacatcaaacaggcagtaatacatctctcgtgcacttaggcaaccatggccgcactcatcagagtgagaagcttaatatctacagaacagtaggcagattttctgcaatctatccggtggctttggaggtctccgattctgatcatatcggttcgagtttagataatgttaactcgaccttagccaatattcctgatcaagggataggatatggtattttaagatatttaaaacaagatataaaagagaaatcaaaaccagacatttcatttaattatatgggcgaatttgataatgaactgcacacagaaagctttacggtatctccgctttcaaccgggaatgatataagtgaagatgaaatttggaattacaagtttaagtttattgtgttggtaagagagaaaaaattgagcattggaattgaatataatcaaaatcagtactataagagtactgtagaaaatctgctcaatcagtatatgcgttatatcaaaaaagcagcagaaaccatttaattaatcggaggttaacgtaaatgaccaattcagttcagcaagataaacaagtaccgaagaaatatcctcaggccgcagtcatgcaaatggtttcagggctggggttttccctggcagttaaaacagcggtagaattggatgtattttccgcctttcaaaatggaccagcttcagcggaagcgatagctgaagcccttgaattgaacccctctgccttattcaggctcttaagagcgctggaatccgtcggtttggtcgcccaagctcaaaatggctattatgatgtaacagagtatggtgccactttgatgcctgggaaagcaaaatccattgagcctttggtagaatatctgctgcatgaaacagtagtgcagtctatgtttaaaatggattatagtatcaaaaccggcaaatccgcttttgaagccatttatggtgataaatggtatgagaataatagtcttgatcaagattacttaaaaacaatggataaggcgatggagatttattcaaaaatgagtctgccatccatattgaaagcttactcatttgaaaagtttgatgttatcgtagacgtcgcgggaggaatgggccagttaataacaggcattttaggtgtggctcctaaatcaaaggggatattgtttgatcttccaaaaacgatacaaagtgcaaaaaagcatttagcatcttcagagatgagcgaacgctgtcagtttacggaagggagtatgtttgaggaaattccttccggcggagacttgtatgtgataagcaaagtgttaaacgattgggatgatgagcatgtggttgctattcttgaaaatatagccggtgccatgtctgatcattccaagctgattatagttgaaaatgtgcctgaagcagacaggctgtcccctgaagaagcttttcgtgatttattatttttagtatgctctgcaggcggcagagtcagaaagataaccgagtttgaacaattgattgaaaaagccggattaacactattaaatgtaattcagactccgagtaaatacacaattttggagtgtggaaagaaataatgttatataagctatctcctttaggagatagcttttttatataaaaagttcaccaatttgactgattgattctgtctatctattgatttctctgataaaatgaaacttataatatttaacataattataaatttgaaccacaaggaggaagaaacatgaaaaagagactcgttatgctatttgccgcggccgccgctgctttgttgcttgtgagcgggttgtgggttccgtcagcgtctgcggcgccggctcctgctttaacacaaatccgtattatcggtgtgacgtctgacggtcagaattaccaatgggaaaatatcggtccgaaccaaatcagcgcatcaaaaccgatgaaggggacaacgggttatttagccgtatatttccaagggtatccgaacaataatacgatccaggcgtttaacaacggaacgaatattacaaatcttacgtcaaaagcgctggaagatgaatatacgaaaaacggcaatatcgttacaggctatattaaatattacagcgttcctctttcttatgtcagttcaggaacgttctctttctccgcaacggggctgaacgggccgtacacgccgttaagcagcggatttttctccattcaggtacagagttaaaacagccgcccggtgctttcatgtatagtttttctctctttccgggaagctattcctaaagaaaagggagggcttacatgatggacaggacactcggatatttgcgcgagtcgctttcgaaccacttggagcatgatgtgtgccggggggtttataaaaagcttcaggtgaagcattatgcaaatgagggcgagttcgtgaaagatctaaatgatctggaaatggatgcgctgaatcaggtgcttgaaaaggaaatcaaatatgctgagaacgagcaggatgagaagcgcacgatggaattgaatgaagtatatgagcttctattttaaagagcctcccggcggccgggaggctttttattgtttcggaaccagtttacagaatcatccaaccctttgtataatggatagttgtgaaaaacacagacggaggagaaacatgaacgaaataaaaaaacagacggttcttgagttgtcatcggttgaaaaagctttggtttatctggtgccgccattattggggctggtcatcggatggtttctgccggtcattacgaagtgggccgtaacattggattggctgccttttcacgggccgctggaaataatcgcttcctttcacggatggaaggctgcggctgcaaccgccgttatcggcttaattgggggagtgtggctgacgcgggcagcttttaaagaaagtcttgtggcagtcgtgacggacagcggggtgtccttaaccatatataatgaagaaagcgtgttttcgaaagacagcatttccggtgtgtttacggatgggaagtatcttgttttattaggcactgaaggacaggagctttttcgggagaagcttgagccggcggttgaaaaagcggctgatgcgtttcgcgcgcatgggtatgtctggctggggacggaagatccttttaaagaagaatacaaacggtgggtgccggacacgccggatttggagcccggggcaaatgctcttttaaaagcgagagaaaaggcgctgaaagaggaggaaaaggctgatgcgaaagagctgaaagcggaaatatccaaactgggcattaccgtgcgggagaaaggatcgcgccaatattggcggatctataaaacgccgtctgcataaaaaaagctgccgccgtttgatacggccgggcagcccgggcacagattatttcttcttgtcatcataatattgaaccgggtacatggagccttcggataccattttgttatcttcaatatcttcgggatgcgggttgcctgctttgttgacggggaatgattcaatatcctgcttcccggagagcgatgttttcatattgcggataaagttcatcaccttttggcggtttgatttatctttgagcaggtaggaagtcactccgacagtcgacacggcaagtcctgaaatgagcagtttttgtttcacgataaaaactcctttctatttatggcttgcagtagttattcccgcttaacggctgtttaaacatcggaaggttaattttggcttgccgctttaatgcgataaagattgacaaaactattttcagaataatattataaatatatgatagcgctggagtcatattttaattgaaaggtgttaactttatgaatcaattacatcgcagaatgggaacgtttgcactcatgatggtcggacttgggtcgatgattggctccggttggttattcggggcgtggcgggcggctcagattgcgggacctgccgcaattatttcctggattatcggtatgatcgtaattttgtttatcgcactttcttacagtgaactgggttcaatgttcccggaagccgggggaatggtaaaatatactcaatattctcatggatcatttattggatttatcgcaggatgggcaaactggattgcgattgtttccgttattccggtggaggcggttgcgtctgttcaatatatgagctcatggccgtgggactgggcaaagtggacaagcaatctcgttcacaacggcacacttacgggagaggggctcggcttcgcatccgtattgctgattatttactttttactgaattattggacagttaacttgttttcaaaagcgaattcattgattaccatctttaaaattattattccggggctgacaatcggagcgctgctgtttaccggttttcacggcggaaacttcacatccggttcaagcattgcgccgaacggctgggcgagcgtgctgacggcggtggccacatcaggtatcgtatttgcgtttaacgggtttcaaagcccgattaacatggccggagaagcaaaaaatcccggcaaatcgattccgattgcggttgtcggttcgctgctggtcgcaaccgtcatttacgtcctattgcaaatcgcatttatcggtgcggttgaaccttccatgatcgttcacggctggagtcacctgaactttaactctccatttgccgatttggcgatcgcattgaatatcaactggcttgtcattattctttatgcggatgcgttcgtatctccgtcgggaacgggtatcacatataccgctacgacgtcacgcatgatttacggcatggaaaaaaataaatatatgccgagcattttcggaaagcttcatccgctgtacggcgtgccgcgccaagcgatgattttcaacctgatcgtatcgtttatctttctgtttttattcagaggatggggcgtgcttgctgaaatcatttccgtagcgacgctgatttcttatatcacgggtcccgtgacggtaatgacgctgcggaggacggcggcggatttgtacaggcctctccgtctgaaaggactcagcgtggttgcaccgctcggcttcgtgttcgcgtctctcgtgctgtattgggcgcgctggccgttaacagggcaggtgctgtttatcattttgatcggccttccgatttatttctactaccaagcgaaagcgaagtggaaaggattccgcagaaactttaaaggcggcgtttggatggttgtctatctgctcagcatgatggtcatttcatggctcggaagtgaaaaattcggcggtctgaacatcattccgtacggatgggatatggggctgatcgcaatcgttgcccttgccttctatgcgtgggcgctgaagagcggattcaagactgagtatttgaaagacgccaaagcaatcaacgatcaattaaaaggcgggcaggcggaagccgctgccggaaaagaataatgattgataaaaaccttgcggtaacgttcccgcaaggttttttgatcaggcaaaaaaacatgggttcggcatcatctccgaacccatgctggctttatgatttatattcttttttaaccttttgaaatatatccgcatagttggtgaacacaccggttacgccccaattcagcagacggcgcatgtccgtctcgctgttcacggtgtaagggtgaagcagtaggccgtggctgcgaatgtttcggacattttgagcgttcagcgctttgtaatccggtccgattccgacggcatatgttttgatgtctgttaaatctgcgtcagtcattgaggtcatctgttccgcttcaagcaattggacggcgggaagtttcggatcgagctgtttgattttcagaaggctctccctgctgaaagactgaatgataacttgtccaagtttcgcatgcttacctgccaatttgtattttttcagtgaggcgatcagtttttcttccatacccggatatgtttcgggcgcctttgtttcaatataatagtttgcatgtctgccgaaccgttttaacacgtcatcaagtgtgggaacgcgaagtccggcgtattgcggttttgctttttccggataggccttattgaaccaagaaccggcgtcgagcttttgaatctctgctaatgtatgatccttcacccagccttgtccgtttgtggtgcggtccagtttttcatcatgcatgacgatcagcttgccgtcttttgtcatttgtaaatccagctcaatatagtcagccttcattttttgcgcagtttcataagaaaggatcgtgtgctccgggacataccccgaagcaccgcgatgggcaatggttaaaattctgtcaggagacaagaggtttccttttcccgccgccgatacaggcgtgacgatgaatgacaataaaccgaatgaaagcaataccaaagcaaacaacttatgtttccgcatgttttcttcccccttaaaaatcaatatctgtctctagtgtagaaaatcgttgtaaatgctgtactgcaaaaatattaatcttttatgttgttttcttacacatgctccgcccgcttgcctgtattccacgtcatagccaagaagacgatggacagcacgcatgaggagataagcatgataaagccgccgttccagtcaaagcggtctacgacataacccatgatggcgttggcgaaagcagagcctccgatgtagccgaaaaacccggttaagccggctgccgttcccgccgcttttttaggcgcaaggtcaatggcctgaagtccgatcagcatgacaggcccatagattaagaatccgatgctgatcagcgcgatattatcgatgagcggatgaccggcagggttaagccagtagaccaatacagcgataaatacgccggccatgaacagcacgccggccggtgcgcggcggcttttgaaaaatcggtcgctgatccagccgcacaaaatcgttcccggaattcccgcatattcataaaggaaataagaccatctggaatcttcaggagagaaccctttcgcttccgtcaaataagtcggcgcccagtcaacgacaccgtaccgcacgaaataaacaaagacattggcaaatgcgatataccacagaaatttattattcagcacgtatttgaaaagaatttctttggtcgtcatctctttttcctggtctttgaacgcatgtttcggatagtcattccggtattcttcaatcggcggaagcccgcaggattgcggcgtgtcccgaacgagaagaacaatcacaaatgaaatgacgatggcgataatcgccggaaagaaaaatacgcttttccaagtaacaaacatggcgatgccgagagtcacgagcggggcgagaatacctccgcctatgttatgggcgacattccatatcgacattttcgttccgcgttcactgatggaaaaccaatgagccatcgtccgtccgcaaggcggccagcccatcccttgaaaccatccgttaataaacataaaaataaacataatcgtcacgcttgacgtgacccatggcatggaaacaaataaaatgttgacgacacctgacaaaaacagacctgtcgcaaggaaatacctcgggttgcagcggtcagacaccatccccataataaatttgctgaagccgtaagcgattgatacggccgcaagcaccaagccaagttccccttttgaaaacccttgttcctgaaaataaggaatagcgaaggcaaagtttttgcgaagtaaataatacccggcatacccgatgaaaatccccaaaaatacctgcagcctgagccgtttataggccgcatccgtctttgaatcatccaatctctcaatatgcggagccggcttgaacaattgaaacatcatatcctcccctttgctgaacgtctatcatgatgtatgtatgactcctttccttgaaaatgacaaaaagaaccagaaatcacccttatgaaagggcgcggtttcctggttctcctcatctccatccaaaaatcattaacttgtatatgatagcgctttcttaaattatcacagtctggcgtgaatgtaaacgctttaaggaaagttttcatttttttgaataaataaccggagggaatatcagccggagcgcgaaagatttgatgtactcgattttgtactcaggcataagatgtgttaggccgaactaagaaaagcgaagggagtgcatctgttgattgatgaattggattttgcgttcggtgttctgccgctttgtatcatcatcctgtcagtcgccggaacgtacctgtttaaaaacgcgttcattatgccggctgccgctttagccgtttgccttatatgcacctttaccatattgaatttctcgtttatcgggtgggccgtcgtgtacacgctcgtctctttcgcgttatcgcatattacgatggtggtgatcagccaaaacaaaaaataggatcggcggcagccgatccagctatcaaaagcagagatgcgttctctgctttgttttatttatgaatgtgcaggaattccttgatgaccgcggtctgttcttctttcggatagcttctgtacagatggctggctaagcggacggggtcaccgaagaagtaccgctcatattgtgtctgtcttgttccaaaggggctcatggtcaaatcccatgcgaggcggaacacttttacccggtcctcagcgttcaattcggccgcctgtaaatattggtcaaggtctcctctgatgtcggaacggaacgctttttcagtcggcaaagtcaccattccgcttgccccgatcagctggatgatttccgtgaagcgcgggtagatgtcagggaaaatcgcgctgaccacgcgaagcggagtgacactcggacgcatataaccccattcgtctgtttccgcatcattctccgacttttccaaaagggctttcatcgtttccagaccggtgatgatctcagccatcttggcctgaatatgctgatattcccccacatctatcgcatcgacaagcgtttgggcgaggcccaggagaaactccgtctttacaatttgtctcgtgataacttgatgaaatgcgaaggcgttaaaagagcttttcatattaaaatcaaaagccgcctcgtaattattataaaaaaatacgcgttcccaagggaccaaaacgtgatcaaatacaacgatagaatccatttcttcatatcttgagctgagcggataatcaaacgatgattttccgagtacgaaagattccctgcagatgaattttactccttttgtattggaagggattgaaaaagcgaacgcttcatccgattcaaaatacatcttaggcagagaaaccacgagcacttcatccgtcaggccgccttgtgtggctaaaatccgcgcgccgtgtatgataaggcctttttcatttttatcgacgacttttgccgagataggtgtcggcgatacgtttacacccatttgtgaacgattcacctgaggggtgataaacgtgtgcgtaaaagaaagatcctgtgcggcagcgcgttcgtacagcgcttgaacatgttccggaaaacattgatcacggtctttcaaaagcgcggcagaggaggcgaagctcatcagcacggtattcatataatccgggcttcgtcccatcattccgtgcgtgtgtctggcccaatgttcgaacatgtttcttcttctttttacgtcttctttcgttttcggctgcaggtatgaaagcccggcccgttcttttttaccgggaagactgtaagtcatttgatctttcatgtccggtttcgtttgcaaatcataaagagagcgcttcgtttccagaaggcccttaaatgcgggatgttcagaaatctgtccctcgatcttttcaccatcaagccaaatctcatttcctagctgatttaatcggtcaatgaacattttgccattaatgatacccatcatgtcgcccttctttctttgcagatccactacctcattatattgaaaacgaaattgggtgttccggttatttccaaaggggaagagccttttttgataaggggggtgaagggattgcatcataaaaaaaccccttaagcagaggggtttttaactgatcatgtctttgtatcgttgttcgaggacaaagtctatcattccggtgatacgggtgttttcagatttttgtctgaaacggtcagacacttggattttccttgaaaacggaaatacagcaaaaatccaaacaaggccggccaggccaaaaaccatctgcagagccatttcaatcaaatcattaaaatgagtgctgaaaaaaaagatatataacgtgatgaatgtgactgtacatacgattttgacagtatgttggaaggtgaggagcggttcagtgaaacacattttcatttgattcagtgtgagcgaatcttgtttcattaaatatgtaagcagttctttgtcattttgacttcgcggaatcaaatcattttctattttttgaacggtgtccttgtatgtctgcatatcaatcttcatacgaatcctccttaaaaaataactccaagaatactcattgagcattcctggagcaaggagctgcctgttcaattatagaaatagtgataaaactgtgctgaacaaggctgcagctcctcctaattcaggtgctaaaacgactaaagcaccgatccctacaataacaataattcctgcgcctgcaatagccatggtattcacgacagaatcccaatccggagagtacacctcttcggaatccggcaatctgaagctcttttgttttattttaaatgtaatggtagttgttagtccagtagtagcactgtcaccgaccggaatatcaggtgtataaattttaaattgaatattcagcgatcccgcagccggattgacatacacttctaaataaccgttgcgcactgacaagctcagactgttaagcaggttttgatacgaatcaatttgtgatgctgtaaaagagacttgtgaatctcccatcagaccggtaatataagctcccggtttgccatttgtaatggtaactgtgttgggagaaccttcgcttggcactgttgccaaaagtgaagtagataaaagaatatccatttcaggtgatgcataaatggtttctgtcttgtcgaattcaaacatggcattcgcaagattcgatatattttctaaagcaggaatggttgttaaaatgtccgtcagtgtgcgcagtcttgcatcatacacgggatcagaaggcggatggacgctgcttgcacccgagtcttttccggagtatccgtctttgtcaatggcgacttttcccgctccgcttccgatcgtgccttcataaaattgatcaaaagcccagtttttcggcatcgggtatccgaggttgccgctgaatccggtcgacatgttagccgtaaagctatatttggtcagacctgcttctgacgtccggatacaaatgtttctcggcccgtataccccgatttcatatttcggcgcagttgagaacgcctgcattttcataaaagctgacttgatttcttggaagtaagggatgattttatccgtgacttcataatcatacgcatcaaaatcgacggcaaagtaaatggtcgttcctgacggaaaacctaatcttcgggcggctgatgcagcgctgtacgcatctctcgttccttggtcttttacaaaataagaagattcatagccgccgtcctgataaatcggaaacacgcttaagccggcattgaaaatcgcggaaagttcttttgacgttaacgctttcgatgtcagtccgctgctagtccgcacattcccggtcagatatcttcccacgatcttatagccattctcacgcaaagttttagccgtatctgccgtcaaaatggcagcggtgtcacaagctgaagcagcccgcgttgtgtcgcctgagcttgataataaagctttaatcgtcggcatgtccgcataacctgtctgcggcaggcacataaattcttggaaagctttcactgccgatacaactccgacgccgtattttccgtcgaattcaccggggtcaaatgatttcccattacagtaaagcgcgtattgaacaatcaaaacaaagcctgtccgtgaatcgccgggagtcaaggtaggacataagctggtcgttccgttcccgaaaaatccattggcgacgcttgtgctcatgccttcttctttttgcagagcatagatgagggccttgtttgtatcgcgggcatataagccgtcacaaggcatcaagccgatgtagtcattgtaatcccggttcaggttctgctggatttggcggattcttttgtcgcctcccgctactaaccgaaaagcgctcatatccagcaaagccttcataatgagtgccgtgacaatgccgtcttgcttagtaagtccggccgctttttgaaactcttttacagcgctttcggtattttcatagaaaacgccagaaaatccgcccgggttaaaccctttacaccacagcgccccctgcagaatgtaattcatgtttgtcggcttagaatcgggagcctgctttttcaacggtttaaacaatctttgtgtcgtcggtccgaagttatcggctggttctgaaataccaagctcaatttgaagcgcccgtgtcagaccgtaaatggtatcccagcctgtttttccgttttccggcaccttgttgtacccgtgtctgcctttgtacgtctcattcagccattgttgtgtttccaggaccatttcgtccattgcaatccctccattacgtgtagtgtgcgttcattcataggtggcaaacgtatgacagtttgtcatgggtgcaggagtttgtccgaggacagccccatcatacaaacgccgatagagaggcattgataggaaaagatctctctatgacaattgatacaaaaacagcaaaatggatagcgctttaaagtaactttatcacttaatcaaaaataacaagaatcataagtagtagtcatatagtcattttcagggctgttttcatctctccctgcagtcaaaatggttagttggacggatttatgattagctatattgtcattaacataaatagggtaaatagttacaggaaggaaggattttctcgatgaaaagcaaaaagatttttaagtcgctcatcattatttttactcttttaatcagcggaattggttttatgggtttttcttctccgcaaaaagcagaggctaaagactggcttcatacttataaaagcgggtatttcactaactatgtgatcaatacatatcatcctaaattcactaagacgacaaaaaagtacagcttgagagccgtgacttttaaatccaacagtaaagggaagggcacgtataaaatatacgttcaaaagcaagtcaacggcaaaggtgcctggaaaacaatcaaaaccgccaatgcaaagaaaaatggaacgacttattttgaaacacctttgttaaaaaaaggagattcatacagatttaaaatggtcaatcaaggttcgaaaaaacgtgtcaattatagtgcgagttggattgtattcgcttcataattttgattttcagcttataatgttttagctgccgcagctgcggcagctttttattttctccggagctcaaccgccagggagaccgcatctgtctcttcgggcgtacgtttgtattcaccgcatcattctggattatgcggaaaggtacatcgtttcaatgaaaagccgatcccgggtccttttgatttgtttgaaaatgttctgatataaaaaaggcgtgccgcggtgtaaaatggctatattgataaaaatggaggttgagatggatcaagattatatgactgagcttgtctcagtccagctgaagaaaatccggtcggagagaggctacacacaggagaaaatggcggatgtgatcggcctttctaaaaagtcgctggtgcagattgagaaagggcgggcgcttgcggaatggccgcacgttgtggcggtttgcgcgcttttcagatcaagtgaaacactgcaatccgtattaggagatgatccgctggaggtcattgaaacggttgctcaccgcacaattgacaggccgaaggggaagacgatgggcggcaaggtgtggtggaaagccatcgagaaaaaaggcgagttccgcttgcagcagcatttgatttcccatcattaccgcatccttgattcttatgatgatctgtggttcagcagttttgaaaaggcagaagctttggagcggcttgatgagctgtttttggaggcggaggaagcgaagcgctgacgcacctccggttgatgtattttctgacaagtgagaaaatatgtataaattccagccaaaggagagattcgaatgaagcctgaagatatcgtccgaagcggcccgaatcagtacatatgcaaggaaggaatcgcaaaagaacttccggggctgctggagacattcagaaaacccgttattgtgaccggaatcaaatcctatcaggcgttctccgattacggcggcggttcttcctgggatgtgattcagcacaaaggatactgttcacctgaggcggtgcgtaaggtctgcgggcaggcggaagacgcggatgtgatcatcggtatcggaggcggcacgattttggatttggcaaaagcggcggcagaccggcttgatattgaggctgtgatgcttccttccattgcggggacgtgtgcggcaagtacgccgttgagtgtcatatatgatgagagcggcaattttatcagagttgattatcacaagcgttcaagctatttgacgcttgttgatccgctgtttttgctttcctctcccattgaatatatgaaaagcgggatcggtgatacgctggcgaaatggtatgaggccgaggcggtcatcagaaatacggaggaagcgccgcctctgatggcgcaggcggggctgagacaggcggaatatatgcgtaatctgttattgcgttacagtgaagccgccgtcgtaagcatggagaaaggcgagctgtccgtgccgttcatccatacggcggaaacgatcattatgcttgcgagaacggtcggcgggtatggcggccgtttgtgcaggatggcaggggcgcatgcggtccacaacggcctcagttttcttcaggagacacatcaggtgctgcacggccagaaggttgcttacggcatattggtgcagctcgcgcttgagaatcggagacatgagattgaagagctgcttccgttttaccgccggctcggtttccccgtcagtctctgtgctctcggcatccttgacaaccatgaggaagcaaagcgccgcatcgcttctcacgcctgccgggcggaagaatcgttatgcttaatggggcaatattgcgggaaggacgtgtcagcggcgattgaatcgctcgaatcagcacaaaagacaggatagagcttgtaatctgtcttgtctttattttttgaatatttccgttataatgagtggggtatagaaagggaggggccaaaggacatgtatcaggcgaagaagatgttgttattaggatcaggcgagctggggaaagaagtcgtcattgaagcgcagcggctcggggttgtcactgtagccgttgacagctatgagcatgctcccgccatgcaggccgcacacaaaagctatgtgattgatatgcttgataaagcgcaggtcagagaagtcattgagaaagaaaaaccggacttaatcgtgccggaagtggaagccattgcgacggatgagctgctgaagctcgaggaagaagggtttcacgtcattccgaatgcgcgtgcggcaaagctgacgatggaccgtgaaggcatcagacggcttgcagcagagacgcttcatcttccgactgccggctatgaattcgcgaatacatacgaagaatttaaagaagcggcggaaacaatcggctttccgtgcgtggtaaagccgctgatgagctcttccggaaaagggcaaagcgtgtgccgctcggcttccgggctgaaaagctgctgggacatggcaatggaaggcggccgggtgaaaaacggccgggtcatcgttgaggaattcattccgtttgaatcagaaatcactcttctgacagtgcgcgcggcgaacggtacgtccttttgcgcgccgatcggacatgaacaaaaagacggtgactatattgaatcatggcagcctcatcatatgacggaacagcagattgaagaggcgaaacacattgcgaaaagcataacggatgagctcggcggatacggtttgttcggggtggagcttttccttactgaagataaagtatatttcagcgaggtgtctccccgtccgcatgatacggggctcgtaacgcttgtgacgcaaaatttgtcagagtttgcgctgcatgtccgcgcggtcttgggattcccgattccggaaatcattcagctgtcgccgggggcaagccgtccgctgaaggcgcccaaagagcttgctgattatgcggttgaaggtttggagaaagctttggcggtaaaaagcactcaggtccgcgtattcggtaaacccgtcacgaaagtcggacgccgtatggcggttgcgctttctgcagccgagaccgttgaagaggccagagaaagagcggccgaagcactcagtcatttatcaattacataaaatgatcttaaaaggcgtttttaccgtaatggtaaggcgccttttttgtttggacagactatatactggaaaacggggttgtgagataatgtatgaggccgttttgtgccggttttttaattcttgaaactttttatgtccgcaatcgttatatgtaatgttctcatttcacggagaaggaaataacaatacatcatacggcttttcattcatcaagaacggacaatccggatcgcagcatggaatatttaagcagggtaatccggaatagaggaaaccatgattgcttaccttaatatgaacggcgaaaaaacaaaaatcaccagattagattgttcaaataacaccaaatgctgtataataaaagaatttgaatgatagcattgaaaggatttcattttatgtttccgtaaaatggagtctttatgcatacgcagtccgatttgatatggttttaattggaggtttgtgtaaactgtgaattatatacctagtatgattacaattggaaattttatttgcgggctcttatcgattcattcccttttgtatcataatatacactctgcggtgatctttattttcaccgggatgtttcttgatttctttgacggtttggccgcccgtaagctgaacgcggtatcggagatgggaagggagcttgactcttttgctgatctcgtgacgttcggcgtagcgccgtccatgctcgcttacagtgtttcactatatacgcttccgttcatcggaattttaatcgcgctttcctacagcatctgcgggatgatccgtctttccagatttaatattgaacaaagcaagctgccgacgtttatcgggatgccgattccgtttgcgggtatgtgtcttgtcattttgagctttatcaataacgcttttcttctgggggcgggaacgatcgcgctcggttatttaatggtcagcaacattaaatttccgcactttaaaaaacaggcgcctgaaaacctggagagcagaagatggaattagttcagcaattaatatccgattacggatatatcgcgatttttcttatgctgacactcggtattatcggattgcctattccggatgaagtcatgatgacgcttgtgggctacttcgctcatttaaacgtgctgaattacgggctctccattctgatcagctttatcggagcgctccttgggatgattatcagctacttcatcggcagaaaagccggccggccgtttattaataagttcgggaaatgggtcggcctgaaggaaaagaggatggagaaagtagacaggtggatgaagaagtacgggccgtacaccattattttaggttatttcatccccggcatcagacacgtgacctgctacttttccggaatcggcagaatggaattcaaaacctacttatgcttcgccgccatcggagcgtttttatggtgttttatttttattactataggaaaattcataggagtaatcaatgtttaatactgccgctaaagttctttaccgttcattgattgaactgactaataatcgattgacgtcttatctcattaaaaacttctgtgaatcgaaactgagcaagccgatgattccgctgttttccaaacactatcgcattaactggaatgaaacggaacgcacggcttctgactttgattcactggcgtcatttttcattcgtgatattaatttgaatctccgccccgtggcaaaagagaagaacgccatcgtcagcccggtggacggcgtcgttcagacggtgggcatgattaatcccaatcaaactttcatggtaaaagggaaggattattcgttcgccgaactgacggggtttaaaagcgccgatcacaagtataacggcgggtgttttgccgtgctttacctgagcccgagacattaccaccgcttccattctcccgtcagctgcacgtataaaaagctggccgagctggggaaacgctcctatcccgttaatacgatggggttaaagtacgggaaagatgtgctctcaaaaaattaccgttatgtgtacgagctgacccgtgctgatcagcagatgctcatgattccggtaggtgcgatgaatattaactcgatcgttcagacaaacaccggaaaccggcttgagacgggggaagagcttggctatttttcatttggatcgaccgttattttagtattcgagaaagatatgtttaccccttcggataacctgactgaaggccgtgaattacaggtcggtcagatcatcggttatgcggagtcacaggaggaggcgtccgctttataaaagctgctcctcttttttatatggtgtaaggaagtgaactttatggaagaaaaggatttgggaaagctgatcgaacagtatcggcatacaggcgatcagcaaattcttgaagcggtgcgggatgcatgccggcctgtcgttgaggcgctcatctcagaactggctgaagacagcgcggatcttctgcgggcaaaaggccgtgaccgttttccgtttattatcggcaagtatcagaccgcggccggcctttcgcttgagacctttttgcgcaatacgtatcggttttattttcagcaggttttaaaaggcgaagcgtgactggaagaaagagtacggacggaaatgttcatctttcgcccgttttcctgtatgatatagtatagtgtgcgtgatcattaatataattgaacagggtgtataaatcatggaaaaacaatatagagttttactttattataaatatgtaaagattgatgagcctgaagagttcacggctcagcatttgaagttttgtaaggagctcggtctgttaggccgtattttgatttctgaggaaggcattaacggcacggtgtccggaacggttgaacagacggaacaatacatgaatgcgctgaaagctgatccgcgttttgccgacatgccgattaaaattgacgaggctgacggccatgcattccgcaaaatgtttgtgcgccataaaaaagagctggtgacgcttcgtctcgaagatgatgttgatccgaatgtcacgacgggcaagcatttgaaaccgaaagacttttatgagcaaatgcaggatcctgacacgatcgtgatcgacgccagaaacgactatgagtatgacctcggtcatttccgcggagcggtcagacctgatattgaggcgttccgtgagctgccggactggattgaagaacacaaagacatgcttgaaggcaaaaaaatcctcacgtactgcacaggcggcgtacgctgtgagaaattttccggctggctgctgaagcagggatttgaagacgtgtcccagcttgacggcggtatcgtcacttacggtaaagatcctgaagtgcaagggcagctgtgggacggacagtgctatgtgtttgacgaaagaatcagcgtaccggtcaaccgcgtagagcacgttatcatcggaaaagattatttcacgggcgagccgtgcgagcgttatgtgaactgcgcaaatccggcatgtaataaaaaaatgatctgcacacctgagaatgaatacaaatacatgcgcagctgcagtcacgaatgccgtacgaacgaacgaaacatgtatgtgaaagagcacgaaatgactcaggaagaaatcaatgaacgccttgctttgattgaaaaagaggatcatgcggcgattgattaatagaaaagaccaccaatgaggtggtcttttttgtgtttacatactttctgtccgggcggtctgatctgccgtgacgggtcctttatatgtgaaggctttttcccatttggatacgacgatgcaggcgaccgcatggccgggcacgttgacaccggttcgcgccatgtccatgacgcggtcgacaccggcaatgatggcgacgccttccgcggggagaccgacggcattcgctgtcgccagaagcacgacgagtgagcctgacgggacggcggcaatgcctttgcttgtcatgacgagcacaagcatcatcagaagctgctgagaaagcggcatctccacatgaaacgcctgcgccaggaaaatacaggacaccgataaatagaggcttgaaccgtcacagttaagcgataaacctgacggaaccacaaaggagacgacccgcttcggacagccgtatttctccatccgatccatcagctgaggcagaatggtttctgtgcttgtcgtggagaaagcgatcaaaaacagatcccaaatcattttcagcacttcaaagtacttgattttaaagataagccccacgatcggaaacagaacgaagaggatcaggaacagcccgagaaacacagtgccgatcagcttcagcatcgggagcagaagcgcgattccgaattgcccgacggaggcggccatcagggcgagaacgccgatcggagcggtgaccatcaccatctgcgtcagcttgaacataatatttgccgtggattcgaagaaactcatgacaggtgcggaggctttgccgatgccggctgcggcaacaccgaataaaatcgcgaaaaaaatgacggcgagaagatcatttttcgccataacgtcaatgatgttaacggggataatatcaagaagcatttgtttcagatcgactactttttccgtatagccggaaagctcgtgaatgtcttttttagcaagatgagagaggttaagtccgactcccggcttcagcacgttcgccaataacagaccgagcgccagaacgagcgtcgtaatcacttcaaaccaaataatcgttttgatgccgagactgcccatttttttcatactgccgctgccggcggctccgataacaatggtcgaaaacacgatcggcacgacaatcattttaatcaggcggataaatccgtctcctacaggccgcagcgccatcccgaaatccgggaagaaatggccgatcaatgctccgatggctaaagcgatcaaaatctggaatgcgataaattttttcaagcgaatcccccttttacttgcgcatttcttacgtaattcgtgaagcaggcggcaaccaccttcctgtccgccataaatttgtcacatgattgactgtgcgaaaggaaggattgctttacattatgtaagcgcaatcattgaatatgacagaaagtcctcattgaaaaaaatgaaggagcataagaataaagaaagatttccgctgaaaatattaaaaattttgataattatcctcttataagtggtatatttgatatgatatggtcaactgcattctcatatatctgtgcatacaagattcgggacagaaaaaacatgcagcccagaaaagactgaaaatttgaacaattagaagaaaggtgtgcttttgttgaatcaactgattgaaagacgtaaggtcacagctagaaaggaaaaaccggattccgcttcattgggatttggcaagtacttcacagattacatgtttgtcatggattacgaagaggggagagggtggcatgatccgagaatcacaccttatgaaccggtccatctggatccttccgcatcggttttccattacgggcaggccgtatttgaagggctgaaggcttacaggtcagaagacggacgggtgttgatgttccgtcctgaccaaaatataaaacggctgaataaatcgttacggcggatgagcatgccacctcttgacgagaagctggcgctggaagcattgatacaattggtggagctggagcaggaatggataccgatagaaaaaggaacctctttatatatccgtccgtttgtgattgcgactgagccttctttaggcgtccggccttcaaagcgttacaagttcatggttgttttgacgccggtcggttcgtattacggcgatcagctgaaaccgatccgtatttatgtggaggatgagtatgtgcgcgccgtcaccggcggagtgggcgacgtcaaaacgtccggaaattatgcggccagcttacaggctcagcggaaagccgaagaactggggtatgatcaggtgctttggctcgacggagtggaaaagaaatatgccgaagaggtaggcagtatgaatatctttttcatcataaacggagaggccgtaacgccggcgttaaacggaagcattctcgggggcatcacacgcgcatctgtgatagagctgttaaaaagctggggcatccgtgtcagggaagaacaggtcgccattgatgacatctatgaggctgcaatgagaggcgaggtgtcggaggtattcggtacgggaaccgcggccgtcatctcgccggtcggcgcgctgcacattcacggagaaacgattgagctgaataacggtttgatcggtgaagtgtcagaaaagctctatgaaacgattgccggcatccaagtcgggaaggtgcgggattcgttcagatgggtcgttgaagtataaatgaaaaaagaacccttgcgccgcagggttctttttttggttattgggattttacggcttgcacgcgggctctgcttttccggtttttcaagtaataagcggtgtagcaaacggccataaatacaattccgcaataaagggcgatggcctggttcggatcaaaagcgatgccgatacaggaggcgaggcataggagaaaggccgctatcggtacggccggatatcccggcgtcctgtatttcaagtctgaaagctggtgcccttctttaagaaatcgtcttctgaacaaaaattgtgatgcggcgatgctcatccacacagccactaccgcaaatcctgagacggagacgagaacaagatagactgtatccgctgcaaatacgcttgacaacaacgacagaatgccgccgatcatactgaagatcagagcgttaaaaggaatgcctttagaggtcagcctggcaaaggcgggatgaagctccccttctttagacagggaccacagcatacgtgatgacgcgtacagccctgaattggccgcggacagaagcgccgttaaaatgacgaaattcatcagatcggccgcataaggcacgccgactctgtcaaataccgtgacaaacgggctttcaatcacaccggcttccttgatggagatcatccctgacagcacaaaaatcgttccgataaagaaaagcgccagccgccagactgtggtcttaatggcgcgcggaacggttttttccggatcggcgctttccccggcggcgattccgatcaattccgtccctgaaaaagcgaagtttactgaaagcatcgtcatcagtatcgggaaaaagccatttggaaaaaggctgccgccatccgtaaagttcgacagcataggtgcggcctcaccgcttttcatcgggacgaggccgaacatcgccgctccgcccaataaaataaacagtaagatggctaagactttaatgcttgagaaccaaaactccgattcagcaaaaaatttcacggagaaggcgtttaataaaaagatgaaaagagcgaataccgcactccacatccaaactgaagtatgcgggaaccagcgctgcatgaagagcccggccgccgtgaattcagagcccagcgccaccgcccacgtcagccagtacagccatgcgaccgtaaagcccgtcgcgggcccgatataggtcttcgcataggtgtggaatgcgcccgtcaccggcatggccactgacagttcaccgaggcaaagcatgacaagatagacgatgcccgcgcccaaaaggtaagcgaaaatggtgcccgccggacccgcctgatgaatggtatacccagagcttaaaaacagccccgttccgatcacacctccgagtgatagcataaagaggtgtctgcttttcatacttctctgaaaattcgtctcgttcttgttgttcattgttttccaactttctgcgagggccgttctaataaaaaatctcatgccggcgaacggcacgagattccggcgaaccggctttttgaatagaatatacaaactattccgattagtcaagttgtttttaaggtcttggcccaatcggcaatggcttggatgtccgcgggtttcgtccggcagcagcctccgatcaggctcacgccgttttcgtaccagctttgcgcgctttttccgaaatggttttcgcacgctgcgcctttccaggtttttgtcaccgggtcatattgttcgccggagttcggataggcgataatcggtttggatgctgcccgtttgatttcttctatcagcggcggaatatattcgatcggtgtgcagttgatgccgatcgctgcgatttggctgcaggagtcaagcagggccgcgcattcggaaataggcgtgccttcgctgatatgccgcccgtctttggcgctgaagctgatccatgcataagtgccggggaattcctccagcagccttgtgatcgcttttgcttctgacagggacggaatggtctcacaggccaaaagatcggcgccggattctatgagggctttcatccgggggcggtgaaagctgatcagctcatcttccgtcagtccgtaatgcccgcgatattcagagccgtcagcgaggctcgcgccgtaaggtccgatagaagcggcgaccaaaggtttaggccggtgtaaacggttttcttcatgcgcccaaaattcatcgcgtgcttgtgcggcaagttcaacagatgtctgaatgagacgtatcgcatcggtttccgggatgccgcgcgctgcaaatccttcaattgtcgattgataactggcggtgatcgcgcaatcagcgccggcggcaaaatattctgcatgcacctgtttgatcagttcgggtctctccaaaagaattttggccgaccacagatcgtcatgtaaatcacagcccatccgctcaagctcggttgccatcgcgccgtctatgatcataaccgggtattcatttaatatttgtgtaatgggattcataggccttcctttctgactttactgaaaatatataaaaagggtaatggacgctattctctttgtcaatgaaccggcggaaaaaaggtgttcaggacgctgcctgaacaccttttgtttaggaaatatgtttgcctttcgcgcttttcgcgatatctgaatactcccagcattcgatcccgtcgtcatcagggagcacatctctgtaaaagacggggtcctttccggctttcttttgccgggcataatcgctcaaagcggcaaatgcttttttcgacagaaggaaaattgcgattaagttcacgaccaccattaagcccatgaacaagtcagccatatcccacacaagctggactttggaaatacagccgaacagtaccattccgagcacgcagatgcggtaaatgaacagccactttttgttctggcttaaaaatccgatattggtttctccgtaataatagttgcccatcagagcgctgaagccgaacaaaagcattaagacggcaaggaaacctgacgcccacgcgccgacatggtcgctcaaggcggcctgagaaagcgcgatgccgctcagtcccggctggtgataagcgtctgaaaataaaatgataagcgccgtgcttgtacaaatgacgagcgtatccgtcaggacgccgaatgcctgaatgagcccctgtttcaccgggtggctcgtcgtagctgtcgccgccgcgttcggagcgcttcccatacccgcttcatttgagaaaatcccgcgtcttacaccttgcatcaaggccgcacctaaagcgccgcccgctgcctgatcaatgccgaacgcattttttacgattagcgacagaacgccgggcaattgggtgatattcgtcagaatgacaaagaaagcgacaccgatatataaaacggccaagacgactacgatgtattccgccattttcgcaattcgtttgacgccgccgaagattacgccgccaaaaaccaagattaaaataatgcccaatgtaagccggctggtgccgaacgcgttttgaaaggcgacgctgatcgtattggattgaacggaattaaaaacaaccccgaatgacagtgtgattaatacggcgaacagcgcgcccatccagcgtttcttcaggcctttttccatgtaataggccgggccgccgcggaatccgttttgatcttttactttataaatttgggccagcgtgctttcaacaaagcttgaagccgaaccgatgactgcgataatccacatccagaaaatagcgcccggaccgccgagtgcgatcgcaatggcgattccggtaatattccctgttccgacacgcgccgccatactgatgcaaaatgcctgaaacggggaaatgctgttttttgtccgggcggccgcgccttccttcaaaacccggatcatttccttcagcatgcggacttgcagaccctttgatctgaacgtaaaaaacagtcccagagaaagaagcagtacgattaacagttttgaccataaaaaatcatttgccgagccgattacattttcaaggaattcctgcatccaatcacctcttggttcgtttgattaaaaaatactgagctcccactcctgtgcgatatgtttcagcagcatgccgccggtcaggctgttgccgtattcatcaatggccggaccgtaaatgccgatgccgcatccgttatgaaaaggctgctctcttctggcgcttgggggaaccaatgccatgatgccgccggataccccgcttttggccgggacgccgacgaaagccgcatatttgcctgacgcattgtacatcccgcacgtcagcatcagggctttggcgagtttcgcgacatctttcggaatgacctgttcccgtcggatcggatggtagccgtcatgggcaagtatcaatccgattaaagcgatgtcctcggttgtaccctccatggcgcactgctttaaatacacttcaagcgtttcttccacatccgcctcgagaaagttcgtttcttttaaatagtaggcgagcgctctgttccgatgcgcggtctgccattcagaacggaagacctcctcgtgaatgtgaggccgttttcctattaatttttcaaaaacggaaaagagatattctaatttattatgcgccgtttcacccggaagcagcgaggcgacggtaatggcgccggcattgatcatcggattgaagggcttcccgggtttatggatttcaagccggatgatagaattaaacgcatcacccgtcggctccacgtccacacgatcgagcacataaggaatgcctctggacatgcatgcggcaataaagctgatgacttttgagatgctctgcaatgtgaacggcacattccattcaccggcatgaatcattgagccatccggctctaatatgcaaatgcccagctgagagtcgttgatttctccgagggcgggtatataatttgcgctttttccattgacggaaaacggtcggtaatgctcgacccaatcttgtaaaagtgaagccagttcctctttttcaaggcgctctctgaccatatctttcataacattcctcctctattgcaagcctgtccgaagcggaaaccggtcttggaaaacgttttcaaaaatagcgtgttccatgttaatgtataatgacatctacagaatcatacaaaatacgacaaaatcattcttaaaataagccgatagatttataaatcagccggagtgtcccgccattcgggtctaaagaaatttgcggactgtatcggtcttgttcaaaatagacagaagaaggaagtgattatgatcaggctcgactatttactgaaaaaagacggctatcttttcgctcttatgctgatcaccgtgccgctggcgggggaactgaaattttaccccctgaatgaggtatatcggatcagcttcggcgccccggcttttttcttttttcttctgctgcttcggcatgtgccggcggtattgtcagggctgttgacaggtgcagccgttgtgggattccggatcggcctggcgtgctgggggggagagcatgccggatttacggcggcttttttcagccaatatcccagtttctttttttactttacatatgcctgtttgttttatgtgctgaaggtcaggcttttttgggatcggccgctcatgatcgggtttctcggttttctcattgaaatggcgtccgatgccgttgaaatgacggttcagttttccggcggcaagcagattatgatgccggacaagctggcggatattgcggttatcgctgtttctcacacatttattgtgctgagttttttcaacgtgatgaagctgcacgaatctcaggtcagggaaaaacaaacgagaaagcagcatgagcacatgctgatgattgtgtctaacttatatgaagaaacgattcatctgaaaaaaacgctgaaaacgacggagcatgtgacgaaagaatcctatcagctgtatcgggaaatgagcgggaacgaccgggagctcgggagccgaatgctgcgccttgcgggagaaattcatgaagtgaaaaaagacaatcagcgaatattcgccggcctgtcgaagctgatttcaaatgagagattccgggattacatgaatgccgccgatctggtcggcctcgttatccgcatcaatgaaaaatacgccgaatctttaggcaaagacattcaattcaaaaacgtgattgaaggagaacaccccgattatcacgtctttaccgtcctgtcgatcttaaataacctgaccgccaatgccgtcgaagccatgggtgacaggggtgagatccgcctcgcgctgcgcagggcggagggggggatggccgaatttgaggcggaagatgacggtcccggcattccggaaaaaatcggagaggtcgtttatgatcccggttttacgtccaaatacgatgaattcggcgcaccttcaacgggcatcgggctttcatacgtgaaggaaatcgtaaccgaacttgacggagacatttcctttcataacaagccaaaaggcgtcatatttacgattaagctgccggtgaagcatttgattgcagaaaggatgaactcataatatgcgtttttttatagctgatgatgaccgggcgatccgttccattttaaaacagatgatcgaggacgaggacttaggagaagtcgtcggtgaggcagaggacggaagccagattgaagggcattatctccatttcaaacaagtcgatattttattaattgatctgctgatgccgggccgggacgggattgagacgatacggcatcttcagggggcgtacaacggaaaagcagtgatgatatcgcaggtggaggcaaaggaaatggtgggagaagcttattctctcggcatcgaatactttatccataaaccgatcaacaaaatcgagatcgtcaccgttttgcgaaaagtaaaagagcggattgaactggaaacctcgatcggcgacatccaacactcgttaagccgtcttattcagcggaatgagccgaaaaaaagcgggccggggggatgcacgagaaatcaatcaaagaaacaggaaaatttcttttgtcggaattaggcatcgtgggagaaagcggggcgcatgacctcatggccgtccttcactatttatttgaggatgaacaggcggaaagaaacatcccgtctttaaagcagatgtttacaaacgccgccatccggaagctgggacctgcggcggcacaagccgaggttaacagagaaatcaaagcctcggaacagcggatcagaagggccgtcattcattcgttaaaccatttcgcttcattgggcacaactgatttttcaaaccccaaatttgaatattacgcctcgaaattctttgatttccccgctgtcagcaagagaatgaaagaaatgcaggccaaggaaaccgtgccgctttctccggttaaagtgaatatgaaaaaattcattcacgtcttttttttggaggcgaaagatttacgcgaaggatcaaaatttgtcagcggaggcagccggtaagctgataaatagggtttacgtatataaggtttttgtgtaaaataatgttaactaagaaggaacggagggatcctgatggctgatcaaattccggttttcgcactaatgaaatagtgtcaaagtctctgccttgagcgcggaggaaaccgggattgtctgcctgaataaggaacctgacagtaatagtgagggggcggcgattatgccgccctctttttggcgtcttcacacatctctttcttctccgcctaaaggcgaagctctgtgtcagtcaataagggaaatggggaaacaagatgacaaaaaaacaaagggaaatagaatccgttttgaacatcgcaaaggaaaatggcttacggttaaaatatgaaggggcggacataaatgaaacgggtatggacttccaagtcgtatttgctgaagatgacagcggcgtgacatgggtgctccgaaagccgcgccgtcccgatgttatcgaaagagcggctgcagaaagcgatgttctcgcgtttctccgcagccatgccgctgtatcagtccccgattggcggattcatacaccggaactgatcgcttatccgaaactggacggaataccggctgccgcaattgatctggataagaaacagtatgtctggaatatggaacacgagccgccttcagacggttttgtcggctcgcttgccgcagcattagccgggctgcacggggcagacacggatgcggcctccagatccggaattgaaatcataaaaccggatgacgtcaggcaaagggcggcggaatcaatggatcatataaaaaaagaaatcggggtttcagaacagctttggaaaagatggcaaacgtggataaatgacagctcgtactggcctgatttttctgcgctgatccatggcgacttgcatcctccgcatattttgatcggcgaaaatcagcgtgtgacgggtctcctcgattggacggaggcaaaggttgccgatccggccaaggattttgtcctttatcaagtgatattaggagaaaaagaaacaaaacggctgatgaagagctacgaagctgagggcgggcgcgtctggccgaaaatgcaggagcatgtgtcagaatggcaggccgcttaccctgtggaaacggcgaagttcgcgcttcagacggggcaagaggagcatatgcaaatggcgcgggacatgctcggactgtccgatccgaaaggttattgacttccgccggatgacagcgtatgatacattttaaaatcatagaacggatgaacaatgctgaggaagagtaagtacgcatcagcgcgcggggttcagagagtcggtggccgctgtgaaccgatccccgtccggtgccgaatgggcttctgaattgctgcgctgaaataacagtaggcggtgccgggattctttccccgttatcaagataggagtattgaaaccctgagtttctgtactttttgagagaatggctcttcagccgttaataaaggtggcaccgcgaaaacctcgtcctttgatggacggggtttttttgcgttgttaaggaggtgatggccatggaaagtgactggagacggacagacaatcaaaaaaggagggatattcatggtgatcgcaaccgacgatcttgagctcacatgtccgcattgtgaaggaaccggcgaggagaaagaagggacgccctgtccgaagtgcagcgcgaagggcgtcatattgaccgctcaaggaaacacgctgctgcattttatcagaaagcatatggatcagtgaaatcaaacgaatatgtaaagaaacagcacaaaacaaaaaagcttgtagaaaaaacatcgttttctctacaagctgctttttcattcttcaaaataaggattcacatggatgagcacttcttcaacatctgaaaagtgtcttttgatttcatttcggatttcccgggctatatcgtgtccctgcttaatcgtcaaatcatgatccaaagataaccggacatcaagcaatttatagtggccgtgttctcttgctcggattttatcgagccgtttgacttgagggcaatccaaaataaccgctttatattcctctatcagttcgggatcaacacttttttccatgagaacgtcaacagacggcctgattaattccattgaaatcttaaaaatgaggtacgccacgatgacactggcaattgcatcggcgtacaacagataggaccatccgcgtgtgttcccgataatcgccaataggacgccgataaaagcggcaagagaggcaacgatatcgcctttatgatcgtatgcaatcgctataatcgctttactgttccatttttccccttgtttgatcgaataacgatataagatctgcttagccacgtaggatatcagagccgcaaacaatgcgctgtattgcgggatgcttggaccttcaacaaaggacgaaatcgcttctatcagaatatacacggaaacgagcactaatatgattcctacaatcgcttcgctgatgatctcagctttgccatgcccgaaaggatggtcttgatcgggcggcttattagaaatgccgatgacggccaggacagcaattgaagccacgacatccgctgcagaatgtataccgtcggcaaaaactgcttcactatcgcctatcagtccaaaaaagatctttcctgccattaagatcagattggctatcaatgcaatcaaagcaacttttttgcttatttgttctctttcacttgtcattttttcctcctataaaactgcacaaaaaaataggagcgctcttgattcgctctccgtatcctttcttgtgtaatcactttgcttatcatatcaattcagtttcgagtgggtctatagcaaggttgtttcctgtttactaataaataaggtgacagaaaaaaagttggagcagggctaaatagtacataaacaaaattgcgctgaatttaaaaatgaactgttgacatttgagtatttatcttttattattatcctgaattcaagatattttaattcgagacaatttaattagagtgcaggataagaacctgccgatcgttttgttttttgatcatacattatttgattttttataccataatatctcgaattcgagataaaggggagtgcgagagaaatggctgaatttgtacagctggtgaatgaaagaagatctgcaagcaactttcttccagaacatccaatcacaagagatgagctcaacgaaatgtttgaattggttgcgttggctccatcagcttttaatttgcagcatacaaaatatgtgacggttcttgacccggaggtaaaagaaaagctgaagcaggccgcaaacggacaatataaagtgttcagctcatcagcggttcttttggttttaggggataagcaggcatatcagcaagcggctgacatctatgaaggattgaaggtgctgggggtattaaataaacaagagtatgatcacatggttcaaaacaccgtttcgttttatgaaaacaggggagaactgtttaagagagatgaggcgataagaaatgcttcactttctgcgatgatgtttatgctgagtgctaaggaaaaaggctgggacacctgtccgatgatagggtttgatcctgaagccgtgaaacagattttgaatatagatgatcaatttgaggtcgtcatgatgattacaatcgggaaagaaaaaatagaaagcagaaggccgcgcggctaccgaaagcctgtgaatgagtttgtggagtatatttaaatatttataaaggagcgcataaaaatggctaaaaaaacgatgggaatccatcatattacagcaattgtcggccaccctcaagagaatgctgatttctacgctggagtgctggggctgcgattggtcaagcaaacggtcaattttgatgatccgggtacgtatcacctttatttcggggatgaaggcgggaagccgggaacaatcatcacattctttccgtgggcggacgcccgtcaaggcatcattggagacggacaggttggcgtgacatcttacgtcgtgccgagaggtgctatggcgttttgggaaaagagacttgaaaagttcaacgtgccatacacaaaaatcgagcgttttggggaacaatatatagaatttgatgacccgcatggcctgcatttagaaatcgtggaaagagaagcaggggaggccaatacgtggactttcggagatgtaaccccggatgttgccattaaaggctttggcggtgcaaccctgttatcagcacagcctgaaaaaacaggtgaactgctggaaaacatcatggggcttgagcgagtcggcaaggaaggagacttcgttcgttatcgttctgccggtgatatcgggaatgtgattgatcttaaattaacgccgatcggccgcggacaaatgggtgtcggcacagtgcatcacatcgcttggcgggctcaggatgacgaagatcaattagattggcaaagattcattgctgcgcacggatatggtgtgactcctgttcaggatagaaactattttaatgcggtttacttcagagaacatggggaaatcttatttgagatcgcaactgatccgccgggctttgcccatgatgagtcacaagaaacaatgggcggaaaattgatgctccctgagcagtatgaaccgcaccgggcacaaattgaacaagggctgctgccgtttgaagtaagagaattagattgatttgacacataaaaaataaagaaacatatagtcaattgatgattgctggatggtaccgtccagcaaagaatcagatgaaatcaaagatgaggagagataaaaatggaagatgcaggactattacttattcgaatcatgattggtgtggtgtttctgttttatggatcacaaaaattattcggctggtttggcggatacgggattaaaggaaccggacaatggttcgagtcaattggagttaaaccaggcaatgccgcggccgctttatcaggtctcggggaactcgcaagcggaattttatttattttaggtgtattcctcccgcttggagctgctatcataacgatcattatgttaggtgccattgtaaaagttcatggagcgaaagggtttgcgaacggtgccggcggttttgaatataacgtggtgctgattgcagtctccatcggagttgcactcatcggttcaggagcttacgctttgcatttttaatataagtatctaagaacagttactgaaaagcggtaactgttcttttatttttcaagcacgacgttaaggtgctctgaatcgcaaaaaagcggatatgatcaatataaatgtgtatagtgaatgtacgagtattgatgagcttggtcatgaaagacgagccgatttgaaggagggttttgatgaaagagctgacagacttacattcattagattctatcgagaattttattaagcagcatcaattcagttttatctacatttcaagacctgcctgtacagtatgtcacgctgttctgccgcagctcagaaaagttttggatcagtttccgaatatcaaattggggcataccaacgctgacgaggtagaagaggttgccggcagattttcagtcttcactgtccccgtgcttcttttgttcattgatgggactgagtttctgagagaagcccgctttgttcattttgaacagctcgaaaaaaggctgaaaagggtttatcagttatatcaagatgtataaagcgttactttacaaataaaaagccccctttaaggggctcaggctgtctagaaaatctcgacagcctttatttttcccttaaaatatccattcccctgtcatataataaaagacccgcacaagagacgcttctcaaaatacagccgaattcgttctgtttgaccaactcgttgaagaggatcacctgcttcgaaaaattgatcagtacatagacttctcttttatcgttgaaaaggtcaaaccttactgcaacgaaaataaaggccgcccctcacttgatccgctgatcttattcaaaatgatgttgaaggttgccgcatacccagccaagcaaggctgggcatatgtaaagaaacagcaaaaaacaaaaaagcttgcagaaaaaacatcattttctctacaagctgaaggccgttatccggccttttttacattattcggaccggggttctaaaaaacgggaccctcccaagtcttttctcatcagatagatatggaaaaaatattctccgacggcgatgatgacggcggaaatgagagcggcaaacgccagtcttcctccggaaatgcccatggacagcggcattcccatcagccagacaacaagaaacgcgattccgaaatcagcggacgccgccgtgatattattccatctcggaagcacgtacaggtcgcccgtaaagtaggaaacggctcccagcacaatggtcatcagcagcacgtcaccgaatgtaaagcgaaaacctaagccgagtatcagatacagaataatgatggtcataatgcctttaatggcaagcgctttaatgtgttccattcgaattcctccttatggaaatcatgttagtatgtttcctcataacgtgaaatataaacccttttttcgtgaacatttgttttctggcttttggctgtcatcactgggccgctgctgaatatgatgaaaggagaaaatacgggaggtgtcatgatggcagtcgtaaaagcgtcgagcgccgatgtcgatctaatggcaaggctgctcagggcggaagcggaaggcgaagggaagcagggaatgcttttggtcggcaatgtgggaatcaatcgggtgcgggcgaattgttctgattttaaaggcctgcgcaccatcaggcagatggtgtttcagccgcacgcgtttgaagcggtgactcacggatacttttaccagagaccgcgtgaatccgagcggaggcttgcccgcaggaacattaacggagaacggttttggccggctaagttcagtctgtggtactttaagccgccgggcaactgcccgcagacttggtatggccagccgtttgtcgccagattcagatcccactgcttctatcagccgacaggtgagacgtgcgaaaacgtgtacaatacattttaatcccgggggcaccgttcttaaaatgaacggtgtttttttaatgttttgtgaagaaaaataggaaaaaagtgcgcttgacggatgacaagccaaaaagaaacagagggggttttcttccggcggggcaaggtttgtcgaaacaatgtgaaaaatgtctcccgccgttcatttttcagccttacaaacccttcacacttcttcatagcggtttaacatttcttttttataataagggcgatcaataagacgaaaggggaactgacatgacacatgacggccgtttagatgaatggatcaaggaattggagaacaaaagctttcagaacaatacgtttgaccgccgcgcatttatacagggcgccgggaaaatcgccggtctttccctcgggttagcgatcgcgcaatccatcggcgcgtttgaagtgaatgccgctccgaaattttcaaactatccgttcaccctcggcgtagcttccggcgacccgctgtctgacagcgtcattctctggacgcgtcttgcccctgacccgctgaatgggggcggcatgccgaagcaggccgtgccggtaaaatgggaaatcgccgcagatgaacatttccgtcacatcgtcaaacgcggaacggaaatggccaagccgaatctcggacactccgtccatgtcgaggcggacgggctcaagcccaataaagtgtactattaccggtttaaaagcgggcatgagctcagccccgtcggccggacgaaaacgctgcccgctcccggcgctgacgtatcggccatgacgtttgcatttgcctcatgccagcagtatgaacacggctattatacggcgtataaacatatggcgaaggaaaagcttgatctcgtattccatctcggagattacatttatgaatacggaccgaacgaatatgtgtcaaaaacgggaaatgtcaggacgcacagcagcgccgaagtgtacacactgtcagattaccgcaaccgtcacgcccaataccgctctgatgccaatctgaaagccgcccacgccgcatttccgtgggtcgtgacgtgggacgatcatgaggtggaaaacaattatgccaatgttatccctgaaaaaggccaatccgttgaagcgtttgtgctcaggagggccgcagcttatcaggcttattatgaacacatgccgctcaggcgcatgtcattgccgaacggtcctgatatgcggctgtacaggcaattttcttatggcaatttagcatcgttcaatgtgcttgatacaagacagtacagagatgatcaggccaacggcgacgggaataagccgccttctgatgagtggagagacccgaagcgcacattgatggggacagagcaggagcaatggctcttcggaaatttagccgcctcaaaagcgaagtggaatgtgctggcgcagcaaatctttttcgcgcaatggaatttcggaacaaccgccaatccgatatacagcatggattcatgggacggctacccggctcagcgggagcgggtcatcaattttataaaaagcaaaaacctgaacaatgtcatcgtgctgacgggtgatgttcatgcaagctgggcgtcaaacctgcataccgattttaatcaaacgaattcaaaaattttcggagccgaattcgtcgggacttccattacatctggaggaaacggggcggataaacgggccgatacggatcagatcttaaaacaaaacccgcatattaagtttttcaacgattaccgcggctatgtccgctgtacggtgactcctgcccaatggagagcggattacagagtggtgccgtacgtgacggagccgggggctgaggtatccacgcgggcttcattcatttatcagaaagaccagacggggattcggaaggtctctcaagcggcggttgcaggcggtttaaagcagtcaaacgaggtggaagaggatcgtttcttcgcccataacaatgcgcatgaaaagcaaatgagaaagaaacgggccaaaatctcacaataaggaggcacactcatgttttcaaatatcggcattcccgggttgatcctgattttcgtcatcgctctcatcattttcggaccttcaaaacttccggaaatcggccgtgccgccggccgcacgctgcttgaatttaaaagcgccgcaaaaacattggtctcaaatgaagagccggacaagcagacggctgagaaagacaaaacggcaggctgaatcctgacatgggggcagacgaatccgcttctgcctctttctctataaggaggatgtacgattggataaaaaagaaacccacttgatcgggcatttagaggaagtccggcagcgtctcattaaaatcgttatcgcctttctcgtgttttttatcggcgcctgctggtttgtgcaggatatttatgactggctgatcaaggatttgcatggcaggctggccgttttagggccgagcgagattttatgggtgtatatgatgattgcgggaatatgcgcccttacggcagcgattccggttgcggcctttcagctctggcgttttacggcgccggctttgaccccgttcgaacgccgcgccgctttgctttacattccggggctttcgcttttgtttattatcggaatttccttcgggtattttgtgctgtttccgattgtgctcggatttttaacacaattatccgccggccattttgacatggtatttacggcggacaagtattttacctttatgctgaatcttacattgccgttcggatttttgtttgaaatgcctctggccgtcatgtttctgacacggctcggaatcgtgaatccaacccggctggcaaaggcgcggaagctttcgtattttttgctgatcgtcgtctcggtgctgattacgcctccggattttatgtctgactttctcgtcatgattccgctgctcgtcctctatgaaatcagtgtgacgctgtcccgcatcgtttaccggaagaaatgggccgaggtgtctgccgcttagtgaagctcgcctccgccggtctcaatatcgtcctcatgcgccgcggcggtcaccgcggcgattttgagcgcttttgtcacgagatccaggctgaggctcggcgcagacttctgcaaggtttgctccggaatgtacgggatgtgtataaacccgccgcggatgtgcggatgatggcaggcgatttcatccatcagcccgtaaaagagatgattgcatacaaacgtccccgccgtgtaggatacagccgcgggaatgccttcctttttgatttcctcaacgatccgtttgatcggaaggccggtccaataggccgcgggaccgctttgagaaatgttttccccgacaggctggtttccttcgttatccggtatgcgcgcctcattcagattgatcgcgacccgttccggcgtgatctgcattctgccgcctgcctgtccgacacaaatgataatgtcaggctgatgctttttgaccgcttcgcgcagcacggcaagagacttataaaaaacggtcggcacttgttcggatacgatagaggcagggccttcatgggaaccgtccagccgtttgaccgcttcccatgaaggattgaccgtttccccgccgaaggggtcaaagcctgtcagtaatacttttttctccatataaaaccctccttttctttttaccatactctataatggacatatattcctgccgaagggggaaccatgtcttgaattcgcctctggtgcaataccgatctttatttccggtgctccgcacacatacgatgctcgccagctgctctcaaagcgctcttgccctgccggtttcaaaagcggtcaatgactatcaggaaagcctgtttcagcatggcggaaactgggaagaagccattggacgtacggagcaggcaaggtgtgaatttgcaaaattgatcggcgcccatcctgaagaaatcgccgttttaccttcagtaacggctgctgtctctgccgtcgtttctgctttaccggattgccgaaagaaacaggcggtgtatacggaattggattttccggcgatcgcccacattttgaaggcacagactgagatggagctttcagtcgtgccgtctgaagatggaatgatcccgttagagcggtatgagacgtacatatcggagcagacgcttttcacctgtgtgccccatgtgtcatatacgtcgggttttgtccaggatataaagcgcattgccgagatatccgcaaagaagggatcgcttctttttgtcgatgcttatcaatcggcggggcacatcccgattgatgtaaaagaatggggagttgatatgctggccgcgggtgcgagaaagtatatgctcggcataccgggaacggcgtttctttatgtcagaaaggaacttgccgaacggctgaagccgaaagtcaccggatggttcgggcagcagcgggcgtcgatgccggatttaacccgtttttcttatgcggacggagccaaacgctttgagaccggaaccccggcatttatcagcatatatgcggcacaggcggctttatctctattaaacgatgccggcacagaccgcattcaccaagaagtaaaaaaactcagcgcatttgcgtatgaatacgcttctgaaaaaggactgaatctcacagggccgccgtctgccgatgacagacccggcatgatttccatacgggatgaaaaagcggcggaaacggctgcgctgttgaggcggaaaaacatcgtatgcgcatccagcggacaaatcatccggctggcgcctcatttctataacacagctgacgatctgatctatgcgattgatgaactggctgaagcgcgcggtatataaaaaaacagcagactcacggggagtctgctgttttcttatgaatgattcactttgacccgtttcataaagaaagcgctgatcaagccgataacggcgacaatcatcgcaaagataaaggcgtgctggacgcccgcaatcagcgcgtgagagtatgcggaaggatcattcgggtttttcgcggtgctcatataattcttctggccggcagccatgatgctgaccgccaccgcagtgccgattgcgccggccatctgctggagcgtattcataatggctgttccgtccgggtaaaattccggcggcagctgatttaagccgttcgtttgcgccggcatcatgatcatggaaatgccgatcatcaggcatgtatgaagcgcgacaatcagaagcgccgtagaagcgccgttaatgtttgagaaaaacgaaagcacagttgccgtgatgacaaacccgggaatgacaagccacttcggcccgtatttatcaaacagacgccccgtcaccggagacataaagccgtttaaaataccgcccggcagcaggatgagcccggacgtaaacgccgtcagcatcagtccgctttgtaaatacataggcaataggagcattgtcgataagataaccatcatacagataaacacaatcacgacaccgagaacaaacatcggatagcggaaagcgcgcagattcatcatcggctgcttcattgtcagctgcctgatggaaaataagatgagcgcgatcgcgccgacagtgagcgaaccgataaccgtcgggcttgaccagccgtctgatccttcgcctgcattgctgaatccgaatacgatgccgccgaacccgatcgtagacagaataatggaaagcacgtcaattttcggttttgtaatgtcagacacgttctgcatgtaggcgatgccgaataaaagagccaacacaagaaacggcagggaaatccagaaaatccaatgccagttcaaatgctctagcacaagccctgaaaatgtcggaccgatcgcaggagcgaacataatgacaagcccgatcgtccccatcgccgctccgcgcttatgcggcgggaagatgacgaggattgtattaaacatcagcggcagcagcagcccggttcctaaagcctgcacgattcttgccgccaaaagaaacggaaagctcggcgcaagcgctgcaatcagcgtgccgataatggaaaaagcgagtgaaacgatgaacagctgtctcgtcgtaaaccattgcaaaagcagacccgataccggcacaagaataccgagaacgagcagatagcccgtcgtcagccactggacggtcgcaggagtgatatgtagctccttcatcagatcagtcaaggcgatattcagcgccgtttcactgaacatgccgataaaccctgccgtcagcaaagaaatcatgatcggcatgactttatattgtttggaaggctgagcgttttccaaaatcattctcctctctttctatacgtacatgtctctcgtattttatgtcttcagcaggttggggatttgtttagaaatatggaggatcggcattttgtcttttttggctaaggacacaatgatgccgccttctatcatggcatttaaaacagtgctgatttccgccgctttctcatcagaaaaaccggctgatcttaatttgcccgcgaacagattctcccattcctgataagcgttttgacaggcctgccggagcttttcgctctttaaagcagtctcggcagccagtaaaccgacaggaaacccttcaaaattctccggacatgtgaattggcttgataagtcctgtaaaaacgcttgaatgctttccgccggatcaagatgagcatcaaggctttcttttattttcatacggatataatggctcatttcattgacagcctcaatggcgagctgctctttgccgtccggaaaatgatagtaaagagaacctttcggcgccccgctttctttaataatctgattcagtcccgtgccgtaatacccctgaagctgaaacagcctggttgccgcggcgaggattttttcccgagaatctccatagctcataatgttcccaccttactgatttgtgacaaatttaaaatatagtgactggtctattatcttgatttcgcatgacggtgtcaaggttttttaacggttattttcttcggaagaatgcctgacaagcgcgttgaccggtgagaggaaaatcatcataaataaagaaaaggagagaaaagaatgaaaaaacaattcatgcccttcattacatttatcacggctctgctcttcatcgcggccggctgctcccaatctcctcaaacgaaagaaacaccgccccagatggcagccgcagcctctgcgaaaaaagacggacttccgaatattaaaattcttgccaccggcggcacaattgcaggcgctgctccttcaaagacgtccgctacggagtacagggcgggggcaatcggagttgatgccctgattcaggccgttccggagataaaagaggccgcgcatgtgagcggagaacaggttgtgaatatcggcagccagaatatgaataacgagacactgctgaaacttgcaaaacgggtaaacaagctgctcaagtctgatgatacagacggcattgtcattacacatggaacagacacacttgaggaaaccgcctactttctcaatctgacggtcaagagtgacaaacccgttgttgtcgccgggtcaatgcggccgtccacggcgatcggagcggacgggccgtccaacttatataacgcggtaaaaacagcggctgcgcctgaggcgaaaggcaaggggacgcttgtcgtattaaatgacagaatcgcttcggcgcgttatgtgacaaaaaccaatacaaccgcgaccgacactttcaaatcggaagaaatgggttatatcggaacaattgctgatgacgtctattttaataacatcatcacccgaaagcatacgaaggatacagatttcaagatagataaacttgataaactgccgcaggtcgatattatatacggctatcaaaatgacggaagctatctctttgaagccgccgtaaaatcaggggcgcaaggcattatttttgcaggcccgggaaacggctcaatgtctgatgcggcgctaaaaggcgctgtaaagtcggtcaaaagcgggctggcggtcgtccgctccacaaggacgggaaacggggcggtaacacctaatcgagagtatgaaaaagaccatttgacagcttcaaactctctcaaccctcaaaaagcgcggattcttctcatgctcgcgctgacaaaaacgcaagatcctaagcggattcaaacctatttcaatgagtactaggagtagagaaccgggtgttctctcctttgtcggtatgccgtattaaagcataagcgtgctttcgggaaaggggcgtctttctcatttttccgctcttttttaattgttgaaaacagtaaaaaatacactattttttccttttcttctctaatagaatgaaaactgcaaaaatattacatagcaggaggaaagttcatgaaacatataaaaagcaaaatcctagtcatccttacagtttgtatgctgtccgtcatttccgtatttgccttccagccgaccgtatcgaaagcctcctcagggcataaccctgtagtcatggttcacggaatcggcggggcgtcttttaactttgcgggaatcaaaacatacttggcatcccaaggctggtcaagaaaagagatgtacgctattgatttcttagacaaaaccggaaacaacagacacaatgcgccgagactgtccaattacgtgaaaaaagtgctcagcgaaacaggtgcgaaaaaagtcgatatcgtcgcgcacagcatgggcggcgccaacacgctctattacattaaaaatcttgacggcggagacaaaatcgccaacgtcgtcacactcggcggagcgaacggccttgtgaccaaccgggcgcttccggggactgatccgaaccaaaagattttatatacatcgatttacagctcagcggacttgatcgttctgaacccgctgtcacgactgatcggcgggaaaaacgtgcagattcacggtgtcggacacatcggacttttgatgaacagccaagtaaacgggctgattaaagaaggtctgaacggcggcggacaaaatacaaattaacagtttcaaagccccggagaatgagaatatcccggggcctttttttcttccatattcttttttcgccgtaaaccaagccctctgaagttatttttgttaaaataataaagttatatcagaattcggagggtttattgtgggaaaagtgaaaagaaatgccccttgcccatgcggcagcgggaagaaatataaaaaatgctgcggaagcaaagaagctgccattccggcagacatcgcggcaaaagaagcgaaacagattcaggaaagcttaatggagtacgcctttacagcacatagagacggcatatcatcatttattaaccagcatgagttcattacggagctggacagacagactaaagacatcggagtcttcaacctcggtatctggggaattttcttccgtccgctggcaggcggcaagacgatttttgaagaatatcttcagaaaaaagccggcggcatcaaccgtccgaaaacacgggaaatcgttgaatcatggaaaagcatgacaccagcggttatggtgcttgaagatgtgaaagaaggaatgattcactttgaagatgtgatgaccaagaaacaattcaaagtggaaatggacgtcagccagcaggatcttccgccggcgggaagcctgattctcggctatccgatccacgaagcggaaaaagcggagttctttatgcagtttacgatcttccctgtgaagcggaccgaagctctaatcagcaaagtgaaaaaggcggctgccccggcccttgcggaaggaaaatcgcctgagcgctttatgcaggaggacttcgacactgtgctggccgctcttttaggaacggcggaagagcctgagcaggctgctgaagaaaaacagacggagtgggcgaacgacatggagaaggaaacggcggacgccattgaaaaaggcctgagcggggatgaatacccggctgagctggttccggccgttattgacctgtggaaaacgttctgtgtcaaaaaaacaccgacgatcagaaagccggaagctttcgcggcggcggttgaatattacgtaaacagtatttctctgaacggcgcgtccgtttctcaagccaagctggcgaagaagtacggcgtcagcgcctcaacgatttccagccgctataaggaaatcgaaggtgctctcacagatgaagccgaacgcttcgccgcagctctgacatcttaatacacagccaaaaaaccttgaagggcacatgcttttcaaggttttttctgcagaaatgctctcggggcaggataattcttaccagttatctaatactaaacagagcgataaaaggaagggagcctgagccatggatgagacacgtacgctgggcaggacggatttacgggtaaagcgtatcggctttggcgctaatgcggtcggaggacataatctgtttccgaatcttaatgatgaaacgggaaaagaactcatccgcacagcgttggacggcggcgtcaattttattgatacggcgtttatatacggtttggggcgttccgaagagttaatcggtgaagttgtcgcagagcgcggcgtgcgggacagcctcgtgattgcgtcaaaaggcgcgcacaaagaggtcaacggacaaatcgagctggacaacagccgtgaatttctccgtagtgaggcggaaaacagcctgaagcggctgaaaacagacgtgattgatttgtattacgtccacttccctgacggcaaaacaccgctctccgaagtggcgggcacgctaaaagaactgaaggacgaagggaaaatcagagcaatcggcgcgtccaatctcagcttcgggcaattgcaggagtttaacgccgacggttatttagaggtttttcaatcagaatattcactgattcagcgtgaggcggagcatgatctgctgccttattgtgaaaagaacggtatttcttttattccttattttccgcttgcttccggcttgctgacgggaaagtttacaaaagacacagtctttgaggacagccgaaaaaacaggccgccgtttcagggagaagcttttcaccaaaacctggagcgagtggataagcttcgggccgttgcggaagaaaaaggggcgcagacagcgcatatcgcactcgcgtggcttctgtcgcagccggcggtggatgcgatcattcccggagccaaacgccccggccagctgaaacacaatctgggcgcgcttgatgtgcaattgaccgaggatgaggttcaatatatcagtgacatcttcaagtgaaaataaaaaaaggaaatagcctgcgctatttcctttcttgctgtcaggacgttttcaaaaacgcttctgtcaatccttccagatcggcgtctgtatccagataccactggccgcgggcgtttttcttcatctcgatttctcttgttacggaagaagaagccggtttcaggcgcataaactcttccggatagacagaaagcaggtggctgacaatttcgttttcatcagcatcggggtgctttccggcatagtcttgcacgcggtcttgcagctggcccgcgagcggagacatatcaagcggcgtcacttttgcttcaaggacggcttttttgcctgacatggatttggtatgcaccttgagctctgtgttatcccgaagcgctgatgacatggcgtcaataatagcggaaatggcttttgaatccgcctgttcttgtgaaatgcctgcagaagcgataaagctggctttcgccgattcctgatatgcggcggccgtcattttttcatttacaccggtcaggcgggtgaaatctttattgtgcttgccgtacagcatcacatcaatgtatgcggataatgcgtccgccgggtcaggttttgcgtttgaggctgtgcctttgactttcagtttataagataaaggcttcgcgtcttttgcctgcggctgatataccaattcatatgatttgccttcgtcagccgtgaagtacagattgcccgtcactgtcttgcccgcatgaagcgtgccgctctgcatctggtcatccttatcggccgccgctgttttcgcgtcatcctgataaagcgagaagtcgctgcttttgacggtaagcgggtctttgcccgtatttttgacggtgaccgttactttcagcgcggccggatgttcagtatcgtctgaagcggcccatgccgtctcttttattttcactttcgccgtgctgctttcctggccgccgctcgtttcgctgctgcatgcggcggtaaatgccgtgagaagcagtatgaaaaacacggcgctcatttttttgatggacatctggtttaccccctgttgttataatgattaattcaatagtcatgaagacagacaggttaattatactagttttgtataaaagagtcttggtaatcatcaatctttttggaagaaaaggaagtgttatgatgaaaaaagaagaattgaaacagctggctctccggatcggtaacgtacctgcccgctacgaaagtaatgtggaagaataccaagaagatgaggttttgttttggtgggaagataagaatgatccggaagccggcatcatggtcgaattggaccgggacggaaaactgaaatccttatcccgtccggctttccggactgatctgccggctctttcggaatcggacatagaagaacggatgcgggcgtttgtagaaacccatcgtccgggggcattggctgagttcgaattggaaaacagcggctccgcaaatgatggtgatgtgagatattcctatgttcagatggctgacggtctgccgcttccgctgaccgggttttacgccgacctgtctttgacaggggaagtaaccggcttttcttaccatgggaaggctgataatctcttaagacccggaacaattgcggacaagcgggaagcattggctcactttgtcaaacatattgaagcggagctgttgttcaccgtactgcatcagtccgtctatgtgcagggggatgacaagcctcatctcgtctatgaaatcgtgtctccgacgcggccgatatcggctgacctgaaggaagagaatgcagaaatagacgaatatgaagggctggaagacgacatgctgccgtatgtcccgatttcacgccctgcacctgaagcggaaaagatgagcatcaatgacatgatcgggctgcacgacggtttttataaagagagggaaactgatcttggagacggccgcatcggcattgcatggcgtcctgaaaaaacaaaatccgtccggaaagataaaagcttagaaagtctgtttaaagaacggaatgaacatgtattgaaaacaatgcatgataaagaatcgggccggctcgccggagtgatgtcatttatacatagtgaaggcgaaccggagttttccgaggaagaatgccatcacatggccatccgctttttattcgccatgtttccggaagcggatcagtatttccgggttcaatatgatgagccggatgatgaaggagaaaacgtgggacttacatataaggcttgttcgggcggcgttgatttgcgattcggagaggggagaatctgcgtcagcaaaaagacgggtcttgtcacgttttatatgccgccggaaattgatccgaaagagctggaggaaatcgatcccgttccttcattgacaatggaagaggcgaaggacgcgatccgccgggccatcaaagccgagctcgcttgggatcgttgttacgatgacggcagctgcggaaaagtgtacaggctcgtatacaagccggttttcccgcggtttattgaggcccatacgggagaagtgatcacgagtttaataggctgaaggtcatgggcgttcgtcccgggtcttttgcgggaattgtgactattgtatgaaaaacagccgctctgaatacggctcttttccctctttgctaaaaatagacacataaaaggcactttcttccctttaaaaggataaggacgtttttatataattaaaaacagttcttttttatacactcttctgaaaggatgaccccattgctgaaagaacatctgagaaaaaaagcgctggagatcgggaacataccgccgcactatgagcttgaaatagaagattatgatgaaaaacaaaaaacgagagcctattatatatggaaagatcgtaaccatccggataaaacggtaacgattgagctgggcgacgacggatctttgcttacctattcacgcaacgactgtccgggttcagacatgcagctgtcagacgccgaattaaagctgacggctcttcggtttgcggcgagacaccgcccgcttacttttatgaatttcatctttcaggcgagggaagaacgcaatgggtgcatccgatttatctatacaaaaaaagtgctcggccggccgcttcccgattcaggttttttcgttgatgtaaccaggagcggcttcgtcgtgcagtttatctattacggggataagggtgaagcgcccgtcccggaaacattcgtcgatcgggaaaaagtcgtctcgcattatatgagtgtgctgacattcagtctcgtctatgatgtggtcaattttgagaacataccgcgtctcgtctatgaaccgattctgccggcttacagctatccggccggtgaagatgatatcgtgccggatcagcagctttgcgaagacaggaatgagccggcaaaaccgcttcctgcgtttgaacataaacgggaaatcagcctggatgaattgatggggtttacctcggatatggttcagacgcgccggcgcgatctcggggatgagatcggaacgacatggcggaaagggtcggttccggaacggaaagatttgagtatcgaaagctattttgaaaccagcaacaaaaatacaatgaagatgaaaacggacaaaaagacagggaaaatgacagcctttaaatcttttattgagcatcagggcccggccttttattctgcggaagagtgtgaggccgtcgcgcttcaatttttatacaagctttatccgagagcggacgagttttttaaaatgaacccgctgaaaacggacggaaggggcaggttccgcttccatttttccgtatggcatcaggatattccgctgcggttcggcgctgcgagaatacttgtcagtcccgtaacggggcttgtggaagcttatatggcgcctgacattgacccggagcagctggagaagatcaatccggtgccggccgttactcccgaagaagcaaaggccgcttttttatccgatttccatctgcggctggagtggcagcgcgattttacgccgtccggcaatgaaggatataagcttgtgtacaggcctgtctatcctccgtacattgatgcgcagaagcgaaaaaagaaaaggttttattagccagggatcatttgtaaatgaggataatctttaaagcctctccaatcgcctccccaatcaaaaccgagcgttttggcaatcgatacgacctcaagccaatcgggcgtgccgtttcggtttccgtcgtacgtcatatcccaaatcaggcttccatcctttttttgcagggcgaagtcgatcgcaaggccgtaattgtggtaagattccccgccttttgcgtaggtgacgatatttcctttttttgaacgtccttgacggtacaattcgttttgttcctcaattgatctgaaaccctctgtgataacgacggtgatgccttttttcagagcggccgtccgcaatagctccgcattctgtttcacgagcggatgaagagcgcttggaatggctctatcttgtaatgccgtctgcggcctcaattctttctgcacataggaaaaacataggtctgcggaaaagaagaggatcagaagcagcgaaattctgactggtagtttcatggtgaattctctctttctttaattgattaaaatctttgtttgctcactgccataaatttgctatgataaaatataacataattagtagccggaggaaggaggcaaatctatgaaatccaagattccatctgaagaagtggccgtaaagatgaatgaatggtataagctgatccgcgcgtttgaagccgataaagctgaagcgctgaagcgggagattcaatatgaactcgaagatatggaagaaaatcaggatttattgttgtatttttcattgatggaatttaggcaccgcatcatgctggataaattaaaacccatgaaagacggcgactgccagcctccgttctctgaaatgctcactgagattgagatgaaccagcaaaagctgaccggcttactggaatattatttttactatttcagaggaatgtatgaatttaagcagaaaaacttcatctcagcgatttctcattataagcgggctgaggaaaagcttgaatatgtggaagatgacatagagaaagccgagtttctgtataaaatttctgaggtgtactatcatatcaagcagactttcttttcgatgaattacgcggggcaggcgcttgatatttacaagaaatatgaattatacggaatgagaagggtgcagtgcaaatttatcattgccggaaatctgatggacgcccagcagcataaaaaagcgctggaatacctcgaatgcgccttggagcacgcggagcggcttgatgatcaatatatgattgctgcggcctattataatatcgggcactgtatgtacagtctgggtgacttttgcaaggcggcggaggattttgaacgggcggctgccggatttgaagcacacagcttccggcaggtcatccaggctgttttttcactcacgcatatctactttaaaacggaaaaatacagtgaagccgccgccagctgcgcgcggggcatgagaagcgcggcggagtgggaagatgagatctatatgacgaaattccgtctgattaaagagctttatcagggggaaggcggacaggattcgctcaaagagtattttgacatcctggaatcaaaggagctgttggctgacacagaggaactgcttcaggacgcggctcatttctttcataaacgggagaactacaaagcggcatcttattttttcagcaggcttgtcggcgtgcaaaaaaggctgcaaatgaacaactacgcataataaaaaaaagaacgagggagcttcggtttcatcgttctttttatgattccttttgttttcagccgattaaaaccgggtacatgctctgtattaacatcagggaggaaatgagacaatgtatcaggatttacaggggaaaacagcgattgtaacaggttcttcgaaaggaatcggaaaagccattgccgaacgcttcggcaaggagcggatgaatgtggttgtgaactacctcggtgattccgccggagcggaagaagcggcggatatcattgagaaagcgggaggcagagccgtcaccgtaaaagccgatgtatcctcagaagaagggattcaggcgctgtttaatgccgcgcaggagcatttcgggggcgtggacgtgatggtcaacaattccggctttaacggagcggaagcgatgccccatgaaatgagcctggaggattggcaaagggtcatcgacgtcaacgtgaccggcacctttttgggggcgaaagcggcactgaaacatatgctcgagcacggcaaaaaaggaacggtcttaaacatatcgagcgttcatcagcaaataccgcgtcctgaaaacgtgcagtactcggcatccaaaggcgggatcaaaatgatgacggaaacgatggcgctcaattacgcagacaaaggcatccgggtgaatgccatcgctcccggcacgatcgccacggagtccaataaggatctggaagatgaaacacataaacaggcccagctgaaaaaaattccgatgaacgccttcggaaaaccggaagaagtcgccgcggccgccgcatggatggtgtcggaagaagcgagttacgtaaccggaacgacacttttcgtagacggaggcatgacgctttatccgtcccagctggaaagataaaagaggaggggaaaccttctcttttttgtttagagaaggggcatacaggaaatggttctctaaaaaacaggagggccgcaagatggcgaatgactggtggaaagacgccgttgtctatcaaatctatccgcgaagcttccaagatacgaacagcgacggcataggcgacctgcggggattatcgcgcgtctcgattatataaaagagcttggcgccgatgtgatatggatctgcccgatttacccgtcgccaaacgtcgataacggctacgatgtgacggatcatcaagcgattatggaatcatacggaacgatggaggactttcacgatctgcttacagaatgccgcagccgcggattaaagcttgtgatggacttcgttttaaatcatacctccacggagcatccttggttcaaagaggcggaaatgaatccggacagcaaataccgcgattattatatttggcggccgggcaccgcggagggcccgccgaccgattgggtgtcggattacggacaatccgtctggcagtacgaagaacatacgggcgaatattacctgcatatgaacgccgttaaacaagccgatctgaattgggaaaatcccgaggttcggcaatcagtatacgagatgatgagattttggctcgataaaggcgtggacggattgcgaatagaccagcttcatcttctgtcaaaaaaagaatacttgccgccatatgaagattacatcgcccgccgggcagatccgaagcctttccggccaaacggagcacggatacatgattacttaaaagaaatgacgaaagaggtattttccaaaatatgacgtgatgtcggtcggcgaggccggatcagtgacgcctgaggaggggctggtttacacgggaaccgatgagcatgaactgaatatgatttttcattttcagcatatggagcttgatcaaaagccgggccaagagcattgggatgtaaaaccgcttgagctgtccgatttgaagaaagtgctcacagactggcaggaaaaactggaacatcaaggctggaatacgctgtattggtgcaatcatgaccagccccggatcgtatcccgcttcggagacgaaggcaaataccgaaaggcatccgccaaaatgcttgccgccctgctttatttcatgaaaggcacgccgtacatttatcagggagaagaactcggcatgacaaacgccccgtttgacagaatagaggactatcaagatattcagaccgtcaatatgtatcacaaaagggtatttgaaatgggccgcaacagggaagaagtcatggcgtccattatggcgaaaagccgcgatcatgcccgtacaccgatgcagtgggacggcagcaagaatgccggatttacggagggcgaaccgtggctgaaggtcaatcccaattacaaaaccgtcaatgcggccgaggctcaggatgatcccaattctatattgaacttttacaaaaaactgatccgcctgcgaaaacagtatgctgatatcataaaaggcagctacacgctgctgtttcccgatgacccgcagctgtttgtgtatgaaagacaggcaaacggacaaaaaatcatatccatcagcaacgtatcgaaagaagaagccgccttttattggccggacggctccgaatctgaaagggccgagctgcttctcagcaactatgaaaataacggcggagcggaatcccgcatcacgttccgcccttacgaaacaagagtttatctgcatgcctgatatgtgatacgacgccccgtccatacatggcgggggctttttaggtaaatcggttatcaatttagaaaaaaattacttgcaaaacgtaattacttcgttttattatggtataggtaacaaatgaacgagaaagtacgctttggaaatcgtcatcattctgatttacagaacagggggaaacggcttgtttaaaaaatggagcggaatcattgtcattgcggcatgctttttaatcgcggcgggctgcggcaattcatcttcaaaaggttcgtcaggttcttcgaaaagcggcaaactgcacgtcgtgacgaccttttatcctatgtacgaattcacgaaacaaattgtcaaagacaaaggcgatgtagacattctcatcccgtcttcggtcgaaccccatgattgggagccgacgccgaaggatatcgccggcattcaaaacgccgatcttttcgtatacaacagcgaatatatggagacatgggttccttcagcggaaaaaagcatgagctctgatcatgcgaagtttgtaaaggcgtcgaaaggaattgacttgctcgaaggttcggatgaagaggaagaggaacatggacacggcggtcatgaccacagccacagcatggaccctcacgtgtggctcagcccggttcttgcgcaaaaagaggtcaaaaccattacggcgcagatcgtaaaacaggacccgaagaataaagcatactatgagaaaaatagtaaagaatatattgcaaaactgcaggatcttgataaactataccgtacaacattaaataaagcgtcgaaaaaagaattgatcacacagcacgcggcattcagctatctcgccaaagaatacggcttaaaacaagtcgcgattgcaggcctttctcctgaagaagagccgagtgcggccaaactggcggatctcaaaacgtttgccaaaaagcatgatgtgaagatcatctattttgaagaagttgcatcgcctaaagttgcagatacacttgccggtgaaatcggcgcgaaaacggaagtgctcaatacactggaaggtttaagccaaaaagaacgggataaaggcatcggttatatcgacattatggagaaaaaccttgatgcactgaaagattcgctattggttaaataacatagtgtgcgccgcggggtgcacactatttctatgcgggaaaggaaggtcagcatgaatctcgttacattacaggatatcgtttttggttattcgcatacacccgtgcttgacggtgtgtcgctggaaatcaaaagcggcgaattcgtcggcattacaggaccgaacggcgcgtcaaaatcgacgctgatgaaagtcatgctcggcatgctcagaccttgggaaggaacggccgagatcagtaaaaaaaacgctgccggaaaacgcctgacaatcggctatgttccgcagcagatttcttcatttaacgcaggattcccaagcacagttctggagcttgtgcaatcaggccgttatacgaaaggaaaatggtttaaacgattgaacgaaacggatcaccacgaggtggaaaacgcgctgaagatggtggaaatgtgggatttccgccaccggaaaatcggcgatttatccggcggacagaagcagaaaatctgcattgcgagaatgcttgcaagcaatccggatctgctgatgcttgatgaaccgacaaccgcggttgactatgaaagcagacagggtttctacgaatttatgcatcatcaggtgaaaaatcacaaccgcaccgtcgtcatggtgacacacgaacaaaatgaagtacagcagtatttggataaagtcatacggcttgagaggggggaaaaaggcggatggaaatgtttgacttggaattcatgcgacgagcttttctagcgggaagcatgatcggaattatggcgccgatattaggcgtatatctcgtgctgagaagacaggcgctgatggcggatacgctgtctcatatttcattgtcgggcgtggccatcggtttttttctcagtaccaatattacggcggcgagcatcgttgtcgtcacgatcggagcgatcggcatcgaatatatgcggcgggcataccgtacatattcagaggtatccatcgcaatcttaatggcggccgggctgtcgtttgcgatgtttctgatcagcctgtcaaaaggcggcgcgtcgatgagcatcgatcaatatttatttggatcgcttgtcacggtcagccagcagcaggtctatattatcggaggcattaccctgctgattctgctttatttcattatattaaacagaccgctctatctgcttacctttgacgaggcgacggcgaagacatcaggcattaacacaaatctcctgtcaatgtcattcagcatcgtgacggggctggcgatttcggtcattattccgattatcggcgtgctgcttgtttccgcgctcctcgtactgcccgcggcttttgcaatccgtatcgccaaagggtttaaatgggtgtttgcggcggccattattatttctcttttcagtgtgttcatggggctgacgtcttcgtaccagctcggaacgcctccggggccgtcaatcactttactgttaatcattctgcttctgctcggctttatgctgcaggggatttggaatgcgtttaaaaaaggaaaagaacgaaaaaaccgccgttaagcggtgcagcagtctcatctgctgcgccgtttgacggctttttttacagaaatatatcagcaagacgctcatatgactctttttttgcttcgaaatcaaagacgttgcacagcaccatcatctcttttgtctgataacgttcggaaagttcaagcagacggcgtttcactgcggcagcagagccgatcaccatccgcttcctattttctgcaatctgtttacggtcctccggcgaatacggataagccttcgcttcttccacactcggcacgcggctgtcggcgccttttccgacacgaagaagccataaatcctggcttaaggcgagttcttccgctttctcatccgtagctgcgcatatgacgaaaatggcacagagtgaggccggagcggaaaaatgggaggaggcccggaaatggtcccgatagatctgaaaggcttttaccccgcgttccggattaatgaaatggccgaagacatagcccgcaccttgaagagcggcgcgtctggcgctgttttccccgaggcccagcacccaaagctgcggggctgtttcaatcaaaggcgctgtttttattccggcataagcatggtccgagggaaccgaatctgtcagaaaggatgataaatcctgaagctgcctgttgaactcggtcatacttttctttaccccgtctgtgagggcgagccggattttcgtcgtgccgcccggtgagcgtccgaccccaaggtcaatccggttcggatgcagcgcctcaagctgacggaaagtttccgcgactttataggggctgtactgcggcagcagcacgccgcctgatccgacacggatggacgttgtggctgcggcggtatgagcgatcataatttccggcgaaacgcttgcgagccctcttgtgccgtgatgctcggcaaaccagtaccgcttatagccccatccttcgctgaggcgggcgagctccgctgaacggcggagcgtctcgtgcggcccgtttcctttggatacgggcgcctgatcaagtatgcttaaatcaatcactcgtctgcccctttcctgacatgtattgatacaaggataggaaaaatgttcagtccccgtcaatttctttgttttctctattctctccggaacgaaggagaatataggaagtaatttttcgccgtttttcgccaaaaattcttatgttttatgaaactttgatataataaaagacgtataacttaataaacaccgggattcttgtcccggaatttagtaaaaatgcgcacttgcggcgtgcttagcggcacccttacagaataggagtgaatcatatggcgatctctttacaaaaaggacagcggattgatttaacaaaaggaaaagccggcctgtcaaaactgctggtcggactcggctgggaccctgtatcatccggcggctttttcggaaagctgttcggcggaggcggtgccaatatcgactgtgacgcttccgtactgatgcttgaaaatgataaaatgacagacagcaaaaacgtcatctatttcggcaatctgaaaagccggtgcggcggtgtcgtacatacgggtgacaacctgacgggtgaaggcgacggtgatgatgaacaaattctcatcgatttgtcgaaagtgcccgctcagattaataaacttgtgtttgtcgtcaatatttacgactgcgtcagacgaaaacaggacttcggcatgattcaaaacgcgttcatccgcgtcgttgatcaggctaatcgcgaagaactggtgacttacaatttaagagataactattcaggcagaacgagcctgatcgcggctgaaatctaccgcgaggacggcgagtggaaattcgccgcagtaggagaaggcacaaacgatacaaaaatcggcgatatcgttaaccgatacgcctaaacgataaaaaggagagtgcacacatggcaatttcattggcaaaaggacaaaaagtagatttgactaaaacaaatccgggtctttctaaagtcgttgtcggccttggctgggatacaaacaaatacgatggcggacatgattttgatttagattccagcgtctttctattaaatgaagcaggaagatgcgcgtcgcccgatgattttattttctataatcagcttgaaggcggaaacggctctgtcgcacattcaggcgacaaccttacaggccagggcgagggcgatgacgaaagtgtaagggtcaacctgagcgcggtgcctgccgctattgacaaaatttcattcgtcatcacgattcatgaagcggaagcgcgcggccaaaacttcggacaagtttccaacgcgttcgttcgcattgtcaatgaagagacaaatgaagagctgatccgctacgatctggctgaagatttctcaattgaaacagccattatcgcaggggagctttacagacataacggcgaatggaaattttccgcgatcggctcaggctatcaaggcggactggcccgtattgcgacagattacggcctgcaaatcggctaaaaccatatcaagcacagaagggagagacggcacatggctattcaattggcgaaaggacagcgtgttgatctgacaaaaacgaaccccggtcttacaaaagcggtgatcggcttaggctgggatacgaacaagtactccggagggcatgactttgaccttgacgcgtcggcttttcttgtcgatgcccatgacaactgtgttaatgatcttgattttgttttctacaataacctggaacacccgagcggcggcgtcatccatacgggagacaaccggacgggcgagggagagggagacgatgaacaaattatcgtcgatttctcaaaaatacccgcaaatattgaaaagatcggcatcaccgtcacgattcatgatgcggaagcgcgcggccaaaatttcggacaagtttcgaacgcgttcgtgcgcgtcgtcgatgaaaacagccagaatgaactgcttcgtttcgatttaggggaagacttctcgattgaaacggcggttgtcgtttgtgagctttaccgccatggggctgaatggaagtttaacgccatcggcagcgggttttccggcggtctggcatcactttgccggaattacggcttgcaggtgtaagcaggaaattaccgttttactaaataggaggaaaaaacttggattttctacatcatattatgtcgacctacgcttccttttttgattggaaaatgtggggtgaggtgctgactgaccctgtatcatgggggctgatcggttccttggttctgctggaagggctgctgtcggccgacaatgcgttagtgcttgcggttatggtaaggcatctgcctgaaaaacagcggaagaaagcattaacatacggattgttcggggcatatattttccgctttatctttatcggaatcgggatgctgctcattaagttctggtggatcaaagtgcttggcgcgctgtacctggcttggctcgtcattaagcatttctggatcggagaaggtgatgacgatacggaaggcatgaagaaaaattcatggatggtccgtacgttcggaattttctgggccactgtcgtttcagttgagttaatggatctggccttctctgttgacagcattttagccgcgtttgcggtatcggaaaaagtgtgggtgctcttgatcggcggtatgctcggcattctcatgatgcgtacagtcgcaaaagtattccttgtgttaattgataaaatccctgagcttgaaaacacggctttcgtgctgatcgggattatcgccgtgaaaatggcggcgagcgcttttgattatgaaatgccgcacgtggtgttcttcggaatcatcatcgctgcatttgtggtcacgtttattatccactatttcaacaaacaaaagcaggttcaggagcagacggctgcatctaaagaagaataaaacaaaaaaggagggagagttcatttccttccttttttgtaccgattatcatgaagagaaaggaggaaaatgatgaagcaggaagaattggtgatccgaaaggccgagccggaaaacgatgactgggaaacgtttctgatgcggccgctgccggaacgtcccggttacgagcgggaaaacgggctggcgtttacccggcttgccggccggattttgggcactccttatgatgagacggagtattacagtaagcttttcgagctgtcttctcatgaaaacatccatgtgttgagcgagacgctggataagaccatcgcgccggaaacgtttcaggcgctgcagcacattcattcggtcaatcaaaaagagaaagggctttcggtttccaggtttgtcgcgtttctcgatgggggcaggctgcttgccaaacacgctgatccgcttatgcaccgccggctgaggaccgcgtttatgacgcttttggaaacctttgcggaccggcatgaaaacgggctgaatcatcccgatttccggcgtgtgctcttggatgtgtcaaagttttcgctgaaccacctgaatccatggctcgaacaagccgatatagagtgtgagatgccgaaggtggtgtggtatggagacgcgaccaaaagccagctctattttctctattatctcatgctgatcggctgtgatgtcctattgtttcatccggctgcggaagatccgttcagcttgattgatccggatgaggagctcagctttgtgataaagctccccgcaacaggcggtcttgagccttttccgaaagaaaagccggacagaacgtccacgacggcctaccggtcaacgaaagaaattgagcatgtgctgaaccatgaggaatccatgatgtataagccttggcagttcagggagcacaccccgcagtccgtgaccttaaaaacgacgtatgatgagttatttctcattgcgaaggagcgggcgtttatccggccgcaatttaaagcggacagggagcgggtggccgttccgaacctttttgcgaaagtgatgggggtttccaaagatacgaaagaatattggaacagactccataccgccgcggactatcaggagacacacatgatccgcagttttccgtttacggaagagctgaaagccaactaccagtatcactacagtcaggttttaaatgaaaaaggagagattgacgcggacaggctgaaaagaagcaacatctggcagtacaagcatctgccttcaggtgtgcagagcgccatcgccaatgtgatttctgacatgtgcagaaacccagggctgaaggctttgcccggggagcagtcaagggatgccgcaatctatttgttccgccaggcgacgaatctgcccgcttcgctgctgcaattgattcagacgtttgattacgcccaaaccgttccgaaactcgttttatatcatacggaacaaaatggcgaactcacacgttctgatgccgccgctcttttgtttttaaataaattcggcgtcgatatcatcttgtataatccgccgggccatcaggacattgagcattatattgaagaaagccaatttgatgtccattggctggaggacatggtgtttcggcaggaatataaggagccgtcactcgtaagaaagctgtttagaaccattacgcaaaagcagggagagtaaataaatatgacagaaaatcaaaatccgcttgttcttgataaaaatgaagagatttctgaacaaaaagcagatgacatcagggcgcagctgcgccaagaccctgaggtgcagcgcatttcgcagcagattgacgtgaaaaaccaaatggagctgcttgagtacggaaaagaaccggcagttgaaatctcgaagttctccgaccgcatcttaaatatgatgaaaacaacaagtgtcacggattcaggcacaatgctgacgcagctcggaaaaatcatggaccgtttcgacaaaaatgatttcgatgaaccaaaaggatttctcgctaaaatgttcaaacgcggcaacagcatgattgaaaagatttttcaaaagtaccgcaccctgggcggagaaattgaaaaaatccacgtcgaaatttcaaaatacaaagatgaaatggcaaagacgaaccatacgcttgaagagatgtatgaaaacaacattaactactacatggagcttgaaaaatatgttgtcgccgggcagatgaagcttgaggaaatgcaggcgctcattccttcttatgaagaaaaagcggccggcggaaaccagcttgcgcaaatgcagcttgatacgctgcgtgacgggcttcaggcgcttgaggaacgtgtctatgatttagatatggcgcggatggtggcgctgcagacagcgccgcagatccgcctccttcagcgcggaaatacgaagctcatcggaaaaatcaattccgctttcgtcattacgattccgattttcaaaaacggcatcattcaggctgtcacagtcaaacggcaaaagcttgtggctgattcaatgagcgagctggaccgccgcacgaatgaaatgctgaagcgcaacgctgaaaatatttcaaaccaaagcgtggagattgcccgtatggcaggccgtccgagcattgacattgagacgattgaaacgtcttggaatacgattgtcagcggtatgcaggaaacgaaacagatcgaggaagagaacagacgtatcagagaagacggagcgaaacggattcaacagcttcaggataatattaaaaacgcagtcttaaagaattaatctgcaccccgcttgcttacggcaagcgggtttttttgcgaaaaaagataatgacaatgtgtaaagacaggtgtaaacttatacggtaatcattttcgatttgaggtgctgcttatgaacaaacaacctgccgtcactccgcgaaaacttctggcgattgccggaatgggctggctgtttgatgcgatggatgtcggaattttatcgtttattatcgccgcgcttcacactgattggaatttaacacccgatcaaatgaaatggatcggaagcgtcaattccatcggtatggcagcgggcgcctttttattcggaatgctggccgacaggatcggccggaaaaaagtgtttatgatcacgctgttattcttttctgtcggaagcggcatatccgcttttgcaacgggattgacggtttttctcatattgcgttttctgatcggaatggggcttggcggggaactgcctgtcgcctcgacgctcgtgtcagaagcgtccgctcccgaaaagcggggacggatcatcgtgctgcttgagagcttttgggcagcgggctggcttcttgcggcggtgatttcctactttgtcataccgtcattcggctggcaggccgcactgctcttaacggcgctggccgcgttttatgcgctgtacttgcggaaaagccttccggaatcaccggcgcatcaggcattgacgcagaaaaaaagcatacgcgggcaggcgggaagtgtctggacgaaaccgtatatccggccgacggtgctgctgtctgtcgtttggttctgcgtcgtcttttcttattacggcatgtttttatggctgccgagcgtgatgctgatgaaaggctacagcatgattgagagcttcgaatacgtccttctgatgacgcttgcccagcttcccggatatttctcagcggcgtggctgatcgaaaaagcggggcggaagaccatcttagtcatctatttgctcggaacggcgggcagcgcttatttcttcggtgccgcggattcattggccatgctgctcacggccggcatgctgctgtcctttttcaatctcggcgcatggggcgtgctttacgcctatacaccggagcagtaccctgcggcgatccgcgcgaccggttccggaacaaccgcggccgtcggcagaatcggcggcattttcggtccgcttctcgtcggatcgcttgcagcacggaacgtttcgtttacagctattttcgctgtcttttgtgcggccatcctgattgccgtcatcaccattattattctcggaaaagaaacgaaacagacagagcttgcgcaatgagcacccttttggggtgctttttttagtgagctgtctgttggcagacctatatttttccttaaaatcccttattttcaggaggcgaaaacttctttttccgggacaatgtcgcaaaaaaattcttgtatttgtaaaaaaaggataggaaatcagtttgcagcacattcgatggaaacgttctcaagcctgataaaagcccgatttcctttataatttatcctcaataaggaggattagagagtatttagaagcataccagaggaaaataagacacagggatgtttttaaagtaatgatacaaaataaacgggattatgatgtttgtttgacttattacaaacgtgttacggtattaaagattgcttattatggagggaaaatatgaatttggatgagaaaccaattaagataaaagtcgaaaatgtatctaaggttttcggaaaacagacaaaaaaagccattcagatgctgtccagcggaaaaaacaaaaaagagatcctgaaagcgaccggatcaaccgttggtgtcaatcaagcaaactttgatgtatatgatggggagatatttgtcatcatgggtctatcggggagcggtaaatcaactttagttcggctgttaaaccggcttattgaaccgactgccgggaatatttatattgatggtgacatgataacaaatatgtcaaaagaccagctccgggaagtgcgccggaaaaaaatcagcatggtctttcaaaaatttgcgctgtttccgcacagaacgattcttgaaaatacggaatacgggttggaactccaaggcgtcgacaaaaaagagcgtgagcaaaaagcgcttgattcgcttaaacttgtcggtcttgaaggctttgaacaccaattcccagatcagctcagcggaggaatgcagcagcgtgtcggacttgcccgcgcattgacgaatgatcctgacattcttctgatggatgaagctttcagtgcgcttgatccgctgatccgcaaagacatgcaggatgagcttttagaccttcatgactctgtcggcaagacgatcatcttcatcacgcatgatcttgatgaagcattgcgcatcggcgacagaatcgtgctgatgaaagacggtaacatcgttcagatcgggacgcctgaagaaattctgatgagcccgtccaatgaatacgttgagaaattcgttgaggacgttgacttatccaaagttctgacagcgggccacatcatgaagcgcgctgaaaccgtgcggattgacaaagggcctcgtgtagcgctgcagctcatgaagaatctcggtatttcttctatttacgccgttgataaacagaaacagcttctcggcgtcattcacgcggcggatgcgaaaaaagcggtggaatccgacttatcgcttcaggatattttaaatactgaatttacgactgtgcatgaaagcacatacttgacggaaattttcgatgtcgtgtctgatgcgaatattccgatcgccgtcacggacgataaggaccgcatgaaaggcattgtcgtaaaaggcgcattaatcggcgcgctttcaggaaataacgattatataaatgttgaagattctgctgaacaagctcaggattcttctgttcagggggtgaagtaaatggacagattgcctagaattccgttagcagatatcgttgaccggtttgttgactggcttaccatgacgttcggaggtttctttgacggaatctcaaacggtttggccgctttcgtaaacgcgattgtgagcggtttgggtttcatcccgtctattttattgactgttatttttgcagctctcgcttggtggatcagtacgagaggaattgcactctttacgttaatcggattccttgttattgattatttgggttattggtcgccgatgctgcaaacgttggcgcttgtcgtcacatctgttttgatttccattattatcggggttccgatcggcatatgggcgtctcagaaagaaacagtccgccgcattgtcacaccgattctggatttaatgcagaccatgccggctttcgtatacctgctgcctgcaattttcttctttaatatcggggttgtgccaggcgttgtggcatctgttattttcgcgatgcctccgacgatccgcatgacagttctcggtattaaacaggttccggctgatctgattgaagcgacggaagcattcggttcaacgacgtctcagcgtctgttcaaggtgcagcttccgcttgccacaaaaacaattcttgccggtattaaccaaagcatcatgcttgctttgtcaatggtcgttatcgcggccatggtcggtgcgccgggcctcggttctgaagtatacagcgccgtgacacagttgaaaaccggtgtcggagtggaagcgggtatcgcgatcgttatcgtagcgattacactcgaccgtatcacgcaaaacattaaagtgaagaagaagagcagggggaatgcctgatgcttaagaaaatcatcggtgtcggcgttaccgctgcgctggctctttctttggctgcctgcggttcgcagactgatgataaggcaacggctgcggaccaggtgaacaaaaccattatcggtatcgatccgggatcggggatcatggccctgacggatgaggccgtgaaggattacggattgaaagactggaatgtcatcacggcgtcaagtgccgccatgacggcgacattgaagaaatcatatgaccggaaaaagccgatcatcgtaacgggctggacgccgcactggatgttctccagatacaagctgaagttccttgatgatccgaaaaaaacgtacggaactgccgagcagattcatacgattacaagaaccggcttcagtaaggaacagcctaacgcggccaaagttctcagccagttcaaatggacgcaggacgatatgggagaagtcatgattgccgttgaggaaggcgaaaagccggccaaagccgcagctgaatatgtgaaaaaacataaagaccaagtggctcaatggacaaaaggcgcccataaagtcaaaggggataaaatcaacctggcttatgtggcatgggacagtgaaatcgcaagtacgaatgtaatcggaaaagtatttcaagacctcggctatgacgtgaagctgacgcaagtggaggcaggaccgatgtggactgcgattgcgacaggcagcgcggatgcgtcattgtctgcttggcttccgaatacccataaggcatatgcgtctaaatataaaggcaaatatgaagatgtaggaacgagtctgacaggcgtcaagatgggtctggtcgttcctcagtacatgaaaaacgtcaattcaattgaagatctgaagaagtaatgaagaaaagcagccctgtaacgggctgcttttttttatgcttcaaacgatttgaggacggcggccgttaatatctcagcgccagtaaagatggcgcttcggtcaaatgtcatttggggatggtgaagtccaggctccagaccgcatcctaggccgagcatcgtcgttttcaagttcggcacctttaacccgtaaaagtgaaaatcctctcctccggttgtcacaagaggttcatccacatgttcttctccgagaatgctgctgatcgcagatgtcatgatggcttccgcctccttgtttcgctcggctgccgggaggctgtgttctttttgcagttcgatttttgcgccgaatgcggcagccgccgcctcacaggctctttcggtttcggcggttaatttctccatggcggcattggtttgtgcgcggagatcaaggctgaacgatgcttttcccggaatgatattggaactttctccgcctgcctgaagctttgtcatcttcacggaatgcgggatgccgggatcaagatgaatgaagctgagtttttggacgagaagagcggcgatttcgatactgttaagcccgagatgcggtctcgcgccgtgggcttcttctccgataatcaggccttctatatgccggcttgagccatgcagaatggacggtgcgcatcggccgtttgccgtttcctgtacggggcgcacgtgcacgccgtataagaagtcaacatcatccagtacgcctttttcaatcattttcagcgctccgccgcctttttcttcagccggctgaaaaataaagcggatggtgcccttcggaagcttcggctgactctttaaaagcatcatcgtgccgagcgccatcgtcatatgtgaatcatgtccgcatgaatggttcgcctgaaagacaccgtccacttcctgccacagcgcgtcaatatccgcccggacagccacaacgggcgagccttctccgatttcgccgacaacaccggtgcaatcatcaaacgtacggattcggcagccggcctctttcagtttttcagtcagatattcagttgtttgatattctttccagcttacttcgggattggcgtgcaggtggtcaaaaatgtccataatgacttgcttttcatgctctgtgagtctgttcatgccgtaagtcctccttcaaaagctgtctgttttttatttttgatattgaaaacaggcaatcggtctgtatataatatagcacatatctgtattttctgaatagtttataaattcaaagcgggatggtgatgttatggctgtgccgaaggccgaacctgtattgaaaaagaagaaattgtttgtgatgcctgatgcttatgtgctgctgttcattgtcgctttactatgcgcgatagcatcatacatcgttcctgcgggggaatttgacagggtgacaaagggcagtgtgacgtccgccgtcccgggaagttatcattctttagaccagtctcctgtcagcccgatcgctttttttaccgcgattcaggaagggatgacaagttccgcgccgattatttttttaatcctgtttacgggcggcaccattgcgattttggagaaaacgggcgccatcaatggattgatcagtaatgtcatcagtacgttccgcaccaaacagctgctgtttattgcaattgtcggatctctattttcgatcctcggcacaaccggcatcgtcgttaattccgtgatcggttttattccgatcggcctgatcgtcgcccgttcgctgaaatgggatgccgtggccggagcggccgtcatttatatcggctgttatgccgggtttaacgcgacgattttatcaccttcaccgctcgggttatcacaaagcatcgcggagctgccgctgttttccggcatcggcctgcggattgccgtctacatttgttttctgctatcatctattttatatatttatcggtatacgagaaggctcagaaaagcaaaggacgccagtctgctggggaacgattggtttccggcagcaggttcaatcccgcaggcttcagatccggaggacaagccagtcccgtttaccgtccgccataaattgattctggctgtcgcggctttgtcgcttgccggctttttatacggcgcgcttactcttgactggtctgattcagagatggccgccgtgttcatttttatctcaatcgtgtcaggcctgattgcgggaatggcggcaaatgatatcgcaaaaacgtttattacaggctgtcaggggctcgtttacggcgcgctgatcgtcggaatggcgagaagcatttccgttattctggaacacggaaagctgcttgatacggtagtcaatggacttgcgtcactgctgcacggtttcagcccgatggcaggcgcaatcggaatgtatatttccagcgccctgcttcattttctgatatcatcgggctcaggggaggcggtcgtatttattccgattttggcgccgcttgccgatctgatgggcatcacgagacaggtcgcggttgaagcggtcatgcttggggaaggcgtcgtaaactgtgtcaatccgacttccggcgttctgatggccgtactggctgccagcggcattccgtacgtaaagtggcttcgcttcatgattccgctggcgctgatttggtttgtcatcggccttgtgtttatctgcataggcgtcctgatcaattggggcccttattaacatttttgtcaatgatatttcggtttatcattatgaatcggcaagatataatgggagttgtaagccattcttaatagtacgggaggaagtcatgaatcagcgtcggaacagactttcaaacgtgaatggaaagagtgagagtgtgaaagagaaagaacgaatgatttggtcagaagtcggaatgcttgtgggcacactgtctttgcttgacatcatcgtacgcggacttgttctgaactgtccgtttagggaatgggccgggagcttggcggttttcttcattataattgtttattattgcatcagggcgggagcgtcgggaatgctcatgccgagaatagacaccaaagaagaactgaaaaagcgggtgaagcagcagcggatagattcaatagcagtcacttttgcggtggcggcgcttacgatgtacgacagggggtttccccatacattctttgcttggctgaaaatgatctttctttttatcgtctgcggaggcattctgtttctgcttcggtatgtcattgtgaagctgtcttacagaagagcgataaaagaaataaaaaagaaatcatcttgacaggtggtttctttttttgtttgaaagcgggaagtctttttaattgataggaatatagatttgaattcactctgccgcgttgctttgatagagagagtgtgataagttgaaatgtaagcgttaacagaattctccagtcttcacaacagttgaaaggagctgaagaaagagtaagaggaatttttgactccgcagtcagtcttcaaaaatgaaataaggagtgtcaaaaatgtttgaaaaacgattcaaaacctctttactgccgttattcgccggatttttattgctgtttcatttggttttgtcaggcccggcggctgcaaacgctgaaactgcaaacaaatcgaatgaggtggccgcgtcatcggtcaaaaacgggaccatccttcatgcctggaattggtcgttcaatacgttaacacaaaatatgaaagagattcgtgatgcgggctatgcagccattcagacgtctccgattaaccaagtaaaggaagggaaccaaggagataaaagcatgaggaactggtactggctgtatcagccgacatcgtaccaaatcggcaaccgttacttaggcactgaacaagaatttaaggacatgtgtgcagccgcggaaaaatatggcgtaaaagtcattgttgatgcggttatcaatcataccaccagcgattacgccgcgatttctgacgagattaagcgtattccaaactggacccatggaaacacacaaattaaaaattggtcggacaggtgggacgtcactcaaaattcattgcttgggctgtatgattggaatacacagaatactgaggtgcaaacctatctgaaacgtttcttggaaagagcattgaatgacggagcggacgggttccgctatgatgccgccaagcatatagagcttccggatgatgggaattacggcagccgattttggccgaatatcacaaatacatcggcggagttccaatacggagaaatcctgcaagacagcgcgtccagagatactgcttatgcgaattatatgaatgtgacggcttctaactatgggcattccatcagatccgctttaaagaaccgtaatctgagtgtgtcgaatatctcccattatgcatctgacgtgtctgcggacaagttggtcacatgggtggaatcacatgatacgtatgccaatgatgaggaagagtccacatggatgagtgatgacgatatccgtttaggctgggcagtgattggttcccgctcaggaagcacgcctcttttcttttccagacctgagggcggaggaaatggggtgcgatttcccggaaaaagtcaaataggagatcgcgggagcgccttatttaaagatcaggcgatcactgcggtcaatcaatttcacaatgtaatggccgggcagcctgaggaactctcgaatccgaatgggaacaatcaaatatttatgaatcagcgcggctcaaaaggcgttgtgctggctaatgcgggatcgtcttctgtcaccgtcaatacttcaacgaaattgcctgacggcaggtatgataatagggccggcgccggttcatttcaagtagcgaacggcaaactgacaggtacgatcaatgccagatccgcggctgttctttattctgatgatattggaaatgcgcctcatgtctttcttgagaattaccaaacgggggcagtccattctttcaatgatcagctgacggtcaccctgcgtgcaaatgcgaaaacagcaaaagccgtttaccaaatcaataatgggcagcagacagcatttaaggatggagaccgattaacgatcgggaaaggagatccaatcggcacgacatacaacatcaggttaaccggaacgaacggcgagggtgcagagagaactcaagaatacacgtttgtcaaaaaagaccaggcccaaaccaacatcattggctatcaaaatccggatcattggggccaggtaaatgcttatatttacaaacatgatggaggcagggccatagaattaaccggatcgtggccggggaaagcaatgactaagaatgcaaatggaatttacacgctgacgctgcctgcgaatgcggatacggccaatgccaaagtgatttttaacaatggcagcgcccaagtgcccgggcagaaccagcccggatttgattatgtgcagaatggtttgtataacaactccggtttaaacggttatcttccgcattaatggatagggctatcatcacatcagcgtgccggcaaaccctcgcttctgggaaaaggacagcacgtcttcaatcacgctgaaaagatacaacatcctaaaacggttccgttttaggatgttgtcaacaatctggaaaccatcatcgatattttttgtccaaaaatcaaacttttctcttgcaaaagtttgtgaagtgttgcacaatataaatgtgaaatacttcacaagttaaaaacagacaccacgaaacactggaggatgagcatacatgatgaacgaacgagtgaacaaagtagcattaatcggagcaggttttgttggaagcagttatgcatttgcgttaattaaccaagggatcacagatgagcttgtgatcattgatgtaaatagagaaaaagccatgggcgatgtcatggatttaaatcacggaaaggcatttgcacctcatccggtgaaaacgtcttacggaacatatgaagattgcaaggatgccgatatcgtatgcatctgtgccggagccaatcaaaaaccgggcgaaacgagacttgagctggtcgaaaaaaatctcgccatttttaaaagcattgtcggtgaagtaatggcaagcggatttgacggcatcttcctcgttgccacaaacccggtcgacattctcacttatgcgacatggacattcagcggtctgccgaaagaacgcgtcatcggcagcggcacgacactggattctgcgcgattccgttatatgctgagtgaatatttcggcgccgctccgcaaaacgtacacgcccacattatcggcgagcacggcgataccgagcttcctgtatggagtcacgccaatatcggcggagtgccggtgcagcaattgctggagaaaaatgcagcttacaaacaggacgagctggatcagatcgtggacgatgtgaaaaacgccgcctaccatattatcgagaaaaaaggcgcgacatattacggagtggcgatgagcctcgcccgcatcacaaaagcgattttgcgtaatgaaaacagtattttaaccgtcagcacatatctggacgggcaatacggtgtaaacgacgtctttatcggcattccggctgtcgtcaatcggaacggcatcgccggtgtgacggaacttgagctgaatgaaacagaacagcgtcaattcaaccatagcgcaaacgtgctgaaagacattctcgctccgcatttcgcggagtaaacaaaaaagcagtacatgacaaacgccatgtactgctttttttaattcgcttttttcgccatttcctgagaggtttttactctcgcttttcccataaacaaaatggtaacggccgcaatgacgatcggcgccagcgcaagcgtgaatacatatgtgatgctttgcgacatggcgtcaataatgcgatccagaatgtgcggcggaatatgggcgcgcgtgccggcctggaaaatctcctgcggatttccgatgttctgcatcgcgccgcccgctcctttcatgccgctgaatgaatctgtgagcttgttggtaaacacattcgtctggatggtcccgaaaatcgtcacaccgagcgtcataccgaatgatctcaaaaacgagtttgttgagttggcgcttccgcggtaacgcggctccagatcgttcatggacgcagccggcagcagtgagaagttgaagccgacgccgaatcctgagatcagcatgaataccgtcagcatcgtacgcgccgtatccggagtcatattggaaagcagcagcattccgataaagaaagcgaccacggaaatcagcatcaaattacggaaccgcactttcgtctggaaaattccgccgatcatacttccgataacagaaccgatcatcatcggtgtcaaaataaagcccgcgctcgtcgcggtgctgccgtacacagcctgaacgaaaatcgggataaataccgctaaaatcacaaatgtggctccgtaaaggaacgccagaatctgtgccgtggcaaataaacggtttttaaacatccaaaatgagataatcggttcttccgcttttctttccacgataaaaaaggcgataaagaacacggcgaacacagcgaacagaccgatgatctgaacggagttccaatcatacgtttttccgccgagctcaagagcgaacatcagaccgacaatggaaaccaccagcgtaatcgcgccggcccagtcgattttctgcttcttgtgttcaagggattctttataataacgaagaatgaaaaacaatgataaaataccgatcggcacgttgatataaaacacccagtgccagctgatggagtcggtaatgagcgcgcctaaaagcggcccgagaacgctggaaaggccgaaaacggcaccgaacatgcccgacatttttccgcgtttttccggcggaaataaatcaaaaatgatcgtgaaggcgatcggcatcagcgcacctccgccgattccctgaatgacgcggtaaataatgagctgatccattgtttgagcgattccgcataatgcagatccgattaagaaaagaataagaccgaataaaaagaaacgcttgcgtccgtacatatcggacagttttccgtaaatcggcataccggccataacggctaccatgtatgatgccgtcacccacgcgaacttatcgaaacttccgaggtccgccacgatatttcccatcgcagtggcaacgattgtattatccatagccgacattaaaatgcccagcaaaagaccgatgacgacaaacttcgtcgaggcgtccttcgcggctgtttgttccatgctttttcctcccatacttacttttgatcattaaatttgctatgatcatattagatttgccgaaaattatcttgatcgtcaagataaattgattttatagggaggcctgtcagttgtcaacaagaaataccagaagcgagacggaggaaaccgccatacagttattccggaagatggccacaaggacgatcctgtttcatcaggcggccgctcaatctctcggtctgtttccgaccgatttgaaatcagctgatatcttaaatgaagcaggcccgatgaccgcaggcgagctcgggaaaaaaaccggcctcagcacaggttcggtaacggcgctcattgaccggctcgaaaaagcgggatatgtcatgaggaaaaaagaccccgaagacaaacggcgggtgatcatcgtgccgctgacagccggaaaagcgaatgtgaagcaattattcagctccttatcccagtccacgatcagcctttgccggcaatataaagaagaagaactgcggctgatattcgattttttaggaaaagcgacggacatgatggaagacgagcttgagaaattaaaataatgtatcatagcacggcccattcatgaataacttgtacaagttgcatgaatgagggggaagccaatgaacatctttttaagctacatcgttctcgggctgtcattgtcagcacctgtcggcccggtcaatgcggcgcaaattgacaaaggcatcaaaaacggcttttggcatgcatggattttcggtctcggcgccatggccgcggacgggctgtatatgattttgatctatttcgggctgtctcaatttttgaccgctccttttgtaaaaacgtttttgtggctcttcggttttttcgtgctgacctacacgggagtcgaaacgttaaaaaatataagggaagccatgaatgtcagaagcggaaaaggaaaaccggctttttacaaaactttcggcgcggggttttttatttctctttccaatccgctgagcattttattctggctcggcatatacgggagcattctcgccaaaaccgctgaatccttcgatgcaaatcagcttttgatttacagctccggcattcttctcggcattttgatctgggatttctgcatggcggtcgctgcgagcactttcagaaatcttcttcatgaaacagcgcttcgctggctgacgggagcggcgggtgtgtctttgatcgttttcggattttatttcggctggcaggggattcaaatgctcatctcataaatagaaggactgtcacctatcgcctgtctccatcataacgtatcctgacgatactggaggtgggccgatggcaagcgggctgtacacaaaaagttgccttgaggaaaagttattggatctgccaaattggcagagaatcgcttttgagcttctatcagaaaaagtaggcgataaagcggatacgtttccgtgcattcccggacgtcagggatttttgacagatcagctccggatatcctttgcgggtgatccccgcgaagagggaaccccggaggaagtggggatgctgctgtccgagtacggaaagatctcaaggaataccggaaaatacgcgtcgctgcttgtgatttttgatacgcctgaggatttagctgagcattattccgttgaggcgtatgaagagctgttctggtcttttttaaaccggctgagcggctgcgacccgaaagactggccggaagacataccggaagaccctgaacattataaatgggagttctgctttgacggcgagccgtattttattctgtgcgcgacgcctgcgcatgaagcgagacaaagcagaagcttcccgttttttatgctggcgtttcagccgagatgggtttttgaaggattaaatgattcaaccgcgttcggacgaaacatgagccggctgatcagaaaacgcttagaggcgtatgatgaagcccctcttcatccccgattggggtggtacggaggaaaagacaatttagaatggaagcaatatttcctccgtgatgatgagacccaagtgtcaaagtgtcccttttcttatttgaagagactgtttaaaccgacgaaataagctatgatccggcagggctgtgtccctgctttttttgtacgatccatgtcacgatcgcaatgacggcgagaaaacaaaggctgaccagaaaaccgggccggctcgatttctcaaacagcgtcccggagacggccgcgacaatcagcacaagggcgataacaatctgtacggttcccatctttgtcgtttcaagcagtttcttgcccgagaacaaaatgaacagccacgtataaagaagcatgaggcccgccgcggttgtcatgtgttcatatatgtttttcggcagcaccaatgacaggatgatggagacgatgagtccggcaaacgtcaatccgagcgcgggccagcagatttttttgttttcctttaatctgaagcatttcggcgcatctccgtcatcagccattgtacaaagcaatgtcgtcaccgcaaacagcgaggcgacgagcgtggaaaatcccgcaataataaaaatcccgttaaaaatatcaagaatgatatctaaatgaaaacccttcagcgatgtaataaacgggctgtcctgttcggtgaatttgcccagcggcactaacagcagcgccaggccgagagaaatgacgtaaatcaccgcaagaacggcaagcatcagccggcctgattttgaggcttcctccggctttttcaaatgcacggtcatcagccccaagacttcaattcctccgaaggcgtaaaacgcataaatcaatcccgtccataaccccatcgctccgtgcgggaacaaatcctttgattcgttcggcacctgcacatccggtttatgagaaaatataccgcacagcgccaatatggcgatgacgataaacataacaatcgccgccgtcttgacaacagcgagcacattttccgttttttgaaaaacggacagccccgtaaatataatcaaaagaccgagcaccgcatagatggaggcgaaaatccacagcggcacattcggaaaccaatgcttcgtaaacagcgagatcgctgtcagctggcttcccgtgatcagcatctcggacgaccagtacacccatccgttgctgaaaccggcccaagtgccgaaagcctttctcgcataagcgcaaaaagaccccttttcgggctgtttggccgagagcttcgcgagctgctcaaagacaaaataggtgccaagcccggcaataagaaatgagatcagcgcggaatatccgcttttgacaatagcgatgctggacccgagaaaaaagcccgtcccgattgtgcagccgacaccgattaaggagagctgccaccaagcgagattccctttaggctggtcctgtgatttactcatgaagttcaacccctttatcaaagcttagattgcggccgtcagaaggggaatatacatccaataaattgctttacatgaaacaaacggccggggttcataatagaagaaaaaaaggagcagtctgatgacacagcaatttatcgtaccgccgaaaaaagggctcggcctgaaggttcacaaagggcagattataaaagtagtcgatgtggaagggcagcaggtggctgattttacggcgtatcatgccaaggacttttatgaacatcttgatcagggcgcgacgatcgatgccaaccagtccattcatgtaaaaacaggtgatcatatttattcaaatttatacaagccgatgctgacgctgattgaggatacagtcggcaagcacgacttgctgcttcccgcctgccgtccggatatgaacaggcttttatacggaaagcataaggacgagctccaggatacgtgctatgacaatatgagcggggcgcttgaaccgttcggggtgccgcggccgcatatgcattacccatttgccatctttatgaacacggtgctcgatgagaaggggaacttatcagtcgaaacccctctttctgacgcgggtgattatgtacggctccgtgcggaaatggatctcgtcgtcgcgttttcatcctgtccgatcgaaaaagggaaatgcaacggggacagcatcacggcgctgcgggtggaaatcagctgatcccggtgtatttggttcacttaaaaactgcacctgtgctatatttaacaaagagtcgtacatagtggcatgattcattttcagtatgaacgggaaatgaatcataaagaaacaatgcaggaggagtgattgggatgagcatccagaaacaaattatgaatgatcttcatgtaaaaccctcaattgatccgaaacaagaaattgaggacagagtgaactttctgaaacaatatttgaaaaaaacaggtgccaaaggctttgttctcggcatcagcggggggcaggattccacgcttgcgggacgcctcgcccaattggcggctgaaagcatcagagaagaaggcggaaacgctgaatttatcgccgtccgccttccgcacggcacacagcaagatgaggatgacgcccaattggcgctcaaattcattaaacctgataaatcatggacatttgatattaagtccgctgtcagcgcgttcgctgatcagtataaaaaagacacgggcgatcagctgtctgactttaacaaaggaaatgtaaaagccagaatgagaatgatcgctcaatatgccatcggcggacaagaggggctgcttgtcatcggaaccgaccatgcggccgaggcggtgaccggtttcttcacgaaatacggtgacggcggagctgatctgctgccgctgaccggattaacgaaacgccagggcagacgtttattagaagaactcggcgcgccggaacgcctgtatttgaaattaccgacggccgatctgctcgatgaaaaaccgcagcagacggatgagaccgagctcggcatcacatacaatgacattgatgattatttagaaggcaaggatgtttcttccgaagtgattgaagcgctggaaaaacgctacctcagtacggagcacaagcgccaggtgccggcatcgatgtttgatgattggtggaaatagaatgaaaaaaacctcccttttgaaagggaggttttttgtttatttcatttttatttatctacactttcataaatccctacccaataccctttgctgctgtcatagtatttgtatttaaaaatccatgttgtaccattcagttcgaaagaagcagcgaaaataccgttagggcttggaacgggcttgatggcattaatgccggcatctgctttcgttgagattgggctattttccacggatggggatgctgttggtgatgcggcaaaggcaggagcggcagacatcagtaaggcaagagacagcgcagaaccggttaacacttttttgaatttcatttcgaacactcccttttcaaatgaaatgtattacagtgttaataattagacgattatccatataattcctcctttatttctaaaatttttttcttaaattgaaaaaaacatcccttcggagggactttttatttattgatccatttgcatgggtcagggacatgttttcaaaacgcttttttatttgatacggatatgattcagcttcaccattaatttgtcggtaaatcttcgaaggctgcctctcgaatcaggctcaagaggcagatttgcttgggcagcgatcgtttctgcggcctgctgaatagacatttggtctgtatggagatgttctgcgaagaggctatcagacaggctgttgatacagcggtcgatttgttttgcggcccaggagttttttccttccgctctggtgcgcaggcgtttcagcaatgtttcctttgaagccagcagggtaaagtggtgaatggtccggccatcctgtctcagcctgctgataatgtcatggaagtattgatcgttcgtaatggtcatgggcacaatgatgatgccctgatatgtatctgacaaataggaaagcatgctgtaattgaattcccgccacagagggtagctttgaaagtcatcttcagcgatatccggcggtatcatcgaacgcatcgcaaaccccatcttttcaggatcatatacgtaagacggtttcagtcttctgtgcagttcaaacgctgtttgtgtttttccggaaccgaaagccccatttatccaaatgatcatcatgatatccccctttttctatatgatacaaaaaaaagacccttcgatcgaagagtcagcgggaaaaaacagacgtatattcccggagcgattcctttatatgcgtaaaggcatgttctccaaaatactcaagagaaacaaaaccgtcatattgtctgttcatcagctcttttaaaaatgctttttgatcgagatctccttggaaaatcggagttggcttgctgagataccagttgtcaaaattccagtgatagtttttcagatgaatatggctgacggtatgatacagcttttctaaagcggacatttggtcaacgtgattgacgtgtaggttggagccgtcaaaaatggtgcggacccgcggatgtccgacatcctccaaaaatgccagtgccgcctccggtgtatccgcgtacgtatcgtaatgaatctcaagcccgatatcgacttcatagtcatctgcgagccgtgccgcctgctgaaattgatcaaccgcacgttgccacttttccggtgacgtccgatgcgaaggaagattgccggcaaagactctgatcaaggggctgtgcagctgtcgtgccgcgcttaatgccccttgaacatcctttaacgcctgcctttcatcctgagcggcgaagtcagtgtacaaactgacggcaggcaccccgaggccttcctcctgaagctgctgatcaagcctgtcgagcgggccgatttcctctatatattgtttagcgtgtccgtaccacagttcgattccgtcaaaggagtgctccttcgcgaaagaaatgatgtcgaaaatatgcttttttttaaatcctgtcgtgcaaaaactcagtttcatcggtaatcctcccgtaactgtctatcatatgtgtacttttccccgggtgagatacggataaacaggtgaaaagggcagacacttttataagcggagtgtcagtgcggcgcacaaattgtttagcgcttttttgcgtcaaagtattaaataattgaccgaagtgttgtacaattaatttcattcgagtaaggggggagaagccattgaaaaatgaaacggagctgacggacttcagtcccgtccgcaataaaccgactcgcgctcgttatgtgatactgtttcttttgttttttatcactgcgattaattatatagaccgtgccagtgtatccatcgccgccccgtccattcagacatcgctgaacataagccccgcgcttttgggcgtcgtcttttccgcattcagctggacctatacgggtatgcagattcccggcgggctcattttggacaaattcgggtcaaaacggacgtacggcgtttctttaatgatctggtctgttttcaccggagtgcaggcttttgcagccagtttcggatttttattcggctgccgcctgattatcgggctggctgaatcgcctgcgtttccggcaaacaatcggattgtcacgacatggtttccaaggcgggaacgcgcctttgccacgggtgtttatacggcgggggaatatgtgggactggcgttcgccacaccggttttattctgggtgttaacggcatttgactggcgcgccgtctttatttcctcaggggtgctcgggcttgttttctccgttttctggttcaaaatgtatcacgagccgaatcggtaccggaaagtgaaccgggaagagcttgattatattagagaaggcggcggactgacagaggtgtctgaatcagccggcaggatcacgtggcgggatttcgtccagcttcttaaataccgcaagcttgtcggcttgtatatcggccaattcgccgtagcctccacgctgttcttctttttgacatggtttccgacttatctggcggaggcaaagcacatggcattcttaaaagtcggcttcgccgcatcaatcccgtatatcgccgcctttttcggcgtattgttcggcggatattggtctgacggaatgatgaaacggggcgtgtcggtgaacgttgcccggaaaacccccgtcatcctcggtcttctgctgacaggctccatcgtgctcgcgaatgttacggattctgctcctgcggttttgacgatcttatccattgcttcttttgcgcagggcatgtccaatatatcctggacgatgctgagtgaggtggcgccaagcgaaacaatcggattggcaggaggcgtgtttaactttttcgccaatatggccggcattatcaccccgcttatcatcgggtttatcgtttctgcgaccggttcatataacggagcgattctgtttgtcggcgctgtcgcatttatcggggcattttcttatattttcattgtcggaaaggtggaacgcattacgctccgatagaaagaaaaactcatctcttcttataaaggatgggttttcttttattgcattatctctatatttcaatattgggttatcatataataaacataactttttcatttcttaggaggatttcgccgaagatgaacgcaaaacgtgccattcccgtaagagaaagaaacatcgtactgatcggattcatgggtgtcggaaagacaacaatcggccagctggtcgctaagaaattatacagagacttcattgatattgatttgcagattgagaaagatttcaatatgtccatccctgaaatgtttgagaaaaaaggtgaagcctttttccgtcaaactgaaaaggactatatattagatatctgccgcaatacgaaattcaagatcgtgtcgcttgggggcggttcgtttaaacaagaggcaatcagacagtgctgcctcgaaaactgtctcgtgctccatcttgatttatcatgggagaattggaagcagcgggctgacctgctgattgaaagccgtcccgttctgcataaccgttccatggatgaaatgcagcagctctttaacgagcgccaaagcatctatgataaacataattcaaaagtggcgacggataatctggaaccagaagaaatcgccgattatatcgtagaaacgttaaaaatcggctgggatctgtatcagccgatgtaaaaagagccgtgacgctgtgagcgtacggcttttttgttttcttttaaacaaacgtttattaaaatgtttagaaaatgagtgtaaaatcgtgttaagatagagtcagaaaattaaatcttataaaacaaaggagaataatcggatatgcaattatacgacttgccgctcgaccaactgcaaacctataaaccaaataaaaccgctcctcatgacttttcggatttttgggcatcatcattacatgagcttgcaaaggaagaggcaaagcctgaattgacggctgaaagctacccggctgacggcgtgaaagtattccggctgacataccgaagcttcggcaaggcggaaattgagggatggtacgccgttcccgaccggcaaggaccgcatccggccatcgtgaaatatcacggctacaacgcgagttatgacggagatatacatgacatcgtaaattgggcgcttcacggatatgccgcgttcggcatgcttgtccgcggccagcacagcagcacagatacaagcgtctcaccgcacggacacgttcccggctggatgacgaaagggattttagataaagatacatattattaccgcggcgtgtacttagacgccgtccgggctttggaagtcatcagcggctttgatgaagtggatgagacgagaatcgccgtcatcggggggagccagggaggcggactttcaatcgccgcggcggcactatctgacattccgagagcggttgcggccgattatccttatttaagcaattttgagcgggccattgatgtcgctcttgatgagccgtatcttgagattaactcttttttcagaaagaacggcagccctgagacggagaaggccgcgatgaatacactggcctattttgatatcatgaatctggcggaccgcgtaaaagttccggtgctcatgtctatcgggctgattgaccgcgtgactccgccgtcgacggtgtttgccgcttacaatcatctggaaacggaaaaagaattgaaggtttaccggtatttcggacatgaatacataccttctttccataaggaaaagctggcctttctgaaagcgcatctgaaaggctgacgacagcgaaaagcccaagtacttgggcttttttcaggaatgatcacggaaaaggacggatacagatggaacaaaggatcatcgaagaattaaaacgaattgaagcacagcacggcgtcaaggtgctttacgccgtagaatcagggagccgcgcatggggatttccgtcaagcgacagcgactacgatgtgcggtttctctatgtgccgaaaaaagaatggtacttttcgatcgaaccgcatagggatgtcatagaagagccgattcatgacatgcttgacatcagcggctgggaactgagaaaagcgctgcggctttttaaaaaatcaaatccgcctcttttggaatggctctcttctgagatgatctattatgaagctttctcagcggctgaaaagcttcgaaaactgaaaatccgcgccttttcgcctgaagccggcatttatcattatctcaatatggcaaaacggaatgaaaaaacggaattgcagggcagtgaagtgaagattaaaaagtatttttatgttttgcgtcctctccttgcctgcagatggattgaaacgttcggctccgtaccgccgatgtcatttcccgtactggccgatgccttattgacggatgaagcgctcatttctgaaatcaatacactgcttacaaggaaaaaaagcggtcaggagctggctccggaaccgagaaatatgatcattcacgcgtttatagaagaagaaatagaacgcatcgggcactatgtcaaaacgatcaaaacaccgaaacctgacataacggaggaactgaatcagctattgattcagaccgtcgaagaggcgtggggggaaaaaggcggaaattgacgattgccgtcatttccgtccgccttttttcggcataatccgcctgctatctaagaagctgattgtggtaaaaccacaaaaatttatcagaatctttgtatttttagaatattgtgagaggatgttttgtccatttacaatagactcatacaaatacttcttagattgcggggtgttaaggttggaagtgattacaagagattttttcttatttttatccaagagcagctttctcaataagatggcgcgaagctggggaagccgtgtggcagccggcaaaatcatcggaggaatggatttccgcagttctatcccgacaatccgacatttgaacagccaggggctgtcagttactgtcgatcatttgggggaatttgtcaacaacggtgacgttgcgaaagaacgcaccgaggagtgcatgcagaccatcgccttaattgctgatgaacagctgaattcccaagtgtcattaaaaatgacgtctttaggtcttgatatagatcttgatctcgtctatgaaaatatgacgaaaatcctccagacggctgaaaaacataaagtcatggtgacgattgacatggaagatgaaacgagatgccagaaaacgctggatatctttaaagacttccggagccggtatgaatatgtaagcaccgtggtgcaggcttatctgtacagaacggagaaggatcttgatgacctcagcccgctgaatccgtttctgcggcttgtcaaaggggcctataaagaatcggaaaaggtggcctatcctgaaaaaagcgacgtcgatgaaaattataaaagactcatccgcaaacagcttttaaaaggacattatacggcagttgccacgcatgatgacaaaatgatcgagtttacaaaacagcttgccgaagagcacggcattccaaacgaccgttttgagtttcagatgctgtacggcatgcgctcgcaaacccagctcagcctggtggaagaaggataccgtatgagagtctacctgccttacggggatgactggtacggctatttcatgagacggctcgccgagcgcccctcaaacatcgcattcgcctttaaaggaatgactaagaagtaaaaaagggagagatgacaatgactacaccttataaacacgaaccattcacgaatttccaagatcaatcgaacgttgaagaatttaagaaagcgcttgcgacggtaaatgagtatctgggaaaagattatccgctcgtcatcaacggtgaaaaggtagagacggaagcgaaaatcgtatccattaaccctgcagacaaagaagaagtcgtcggaaaagtgtcaaaggcgtcccaggagcacgctgagcaggcgattgaagcggctgcgaaagcgttcgaagagtggagatacacatcccctgaagaaagagctgccgttttgttccgcgcggctgccaaagtccgccgcagaaagcacgaattctccgccctgctcgtcaaggaagccggaaagccttggaatgaagctgatgcggatacggcggaagccatcgactttatggaatactacgcgcgccagatggttgaattggcaaaaggcaagccggtcaacagccgcgaaggcgagaagaaccaatatgtctacacaccgaccggcgtaacggtcgtcattccgccatggaacttcctctttgcgattatggcgggaacgacggtggcaccgatcgtaacgggcaacacggtcgttcttaaaccggcaagcgcgacaccggtcatcgcggcgaagttcgtagaagtgcttgaggaatcaggtcttccgaagggcgttgtcaactttgtgccgggaagcggagcggaagtgggagactatctcgtcgatcacccgaaaacaagcatcattacgtttacgggatcacgtgaagtcggtacgagaattttcgaacgcgcggcgaaagtgcagccgggccagcagcacttaaagcgtgttatcgctgaaatgggcggtaaagatacggttgttgtcgatgaggacgcggacattgaattggcggctcaatccatctttacatcagcattcggcttcgctggacaaaaatgttctgcaggttcacgtgcagttgtccatgaaaaagtgtatgatcaagtattagagcgcgtcatcgaaatcactgaatcaaaagtgacggcaagccctgacagcgctgacgtgtatatgggacctgtcatcgaccaaggttcttacgacaagatcatgagctacattgaaatcggaaaagaagaaggccgtttagtaagcggcggcaccggagatgattcaaaaggctactttatcaagccgacgatcttcgctgaccttgatccgaaagccagactcatgcaggaagaaattttcgggccggtcgtggcgttttctaaagtatcaaactttgatgaagcactggaagtggccaacaatactgaatacggtttgacaggcgcggtcattacaaataaccgcaaacatattgaacgggcgaaacaggaattccatgtcggcaacctgtacttcaaccgcaattgtacgggagcgattgtcggctaccatccgttcggaggcttcaaaatgtccggcactgattcaaaagcgggcggcccggattatttggcccttcacatgcaggcgaaaacaatcagtgaaatgttttaagagggactgaatgggcatcctcctcgcggggggtgtccatttcaccataaacatataaagcggaggaggaaatgccatagcaaacattcagttgattatttccatttgtatttatatggcgggcatgctgtttatcggttattttgcctacagacggacgtcaaatctgacggattacatgctcggggggcgttctttaggccctgccgtcacagcgctcagcgcgggggcggcggatatgagcggatggctcttgatggggcttccgggcgccatgttctcaacgggattaagcggcgcttggattgtgatcggacttgtgctcggggcgtgggcgaactggcttttcgtcgcgccgagactgagaacgtataccgaaaaagcggggaattccatcaccattccgggtttccttgaaaaccgtttcggtgatcatacgaagcttctcagactgttttcgggtctcgtcattctcgtctttttcactttttacgtatcatccggcatggtgtccggaggtgtcttattcaacagcattttagggttgaattaccacacgggactgtgggtcgtgacaggcgtcgttgtcgcctacaccttgttcgggggctttttggcggtaagctggacggactttgttcaagggatcattatgtttgcggcgcttattcttgtgccgattgtgacgattttccatacgggcggcccgggggaaaccgttgccgatatccgttccgtcaacccggaactgtttaatatgttcaaagggacgaccgtcctcggcattatttctttatttgcgtgggggctcggctatttcgggcagccgcatattattgtgcgttttatggcgatcacatctgtgaaagagatcaaacgcgccagacggatcggaatgggatggatgattttgtctgcactcggcgcgctgtttacgggtcttgcgggaatcgcgtattaccaccagcgcgggttgaagctggctgatccggaaaccatttttattcagctcggcaacattctgttccacccgattattacgggatttctcatttctgcgattttagcggccattatgagtacgatttcgtctcagctgctcgttacgtccagttctttagtagaggatttgtataagtccatgttcaggcgttcagcttctgataaggaactcgtatttctggggagaatggcagtgcttgcggtgtcaatcatcgctttggtgctcgcctgggagaaaaacaacacgatacttggtcttgtcagctatgcatgggcgggattcggcgcttcattcgggccggtcgtactgctcagtttattttggaaacggatgacgaaatggggggcactcgccggcatgattgcgggagcgattaccgtaatcatttgggcgaatgccagtctttcagactttttgtacgaaatcattccgggctttgctgtaagccttgccgctgtatttgttgtcagcttattgacacaggctccgtcaaaagatgtcacagatcagtttcatgactaccgtgatacactttctcaataaaagcaaggaacgagaggaagaagggaccgccctttttcctcttttcacgatacaggctttcggatcattccgttttgggagtatatgaatttttttctatacaaaaagtcacccctcagagtatgataaagataaaaagagcataggagaaataggtatggaagagcttttagagagagttttttcatttacggacattgataaattaattgatttcatcagttatgaattgcagaagcccgttattctggaaagcgcggatttctttttgcttgcctataattcttattacattaatcacttcgactccgccaaccagcagacgatattctcaaaaaaatgccccgtgcagatttttgaaaggtttctgaaggacggggtgatcgaaaagctgaaaaccgttcctgaaccgttccgtgtcgaaaaaatagacagtatcggattgaatcagagagtggttgtaagcgcaaaacataaaggggaagtgatgggctacatctggattcaggagctcgaccgaaacttgacggacgaggagctcgattttttatatgaaacttcattccatgtcggaaaaatcatctacaaaacgaaccggctgaaacaggaaaaagaagagagagcggaagacctggtgaaacgggcgatctttcagcaattctcctctgaaaaggagttcaggcgggaagcggaaaagatgaacgccgtgctgccgtcggttttttcggtagtcgtcctgcacgccgcaaatggggatggggaggcagtcgaagatgtaaaggaaaatatcaaatcgtacttgaatttgcgggataaagtcagccacgtcttaaccattgattccaatattgtcatcgtcgtcgcaagcttctcgcaaaaaagctccggcacttcggcagcatctgaattcatccacaaactgctgactcattttcactttcagaagatccccactcccatctatatcggaatcggcaatgaatacagcagcatcctgaagctcggcaaaagttatatagaagcccttgaagttataaaggccgccgaaattaccggaaaccaggaaaatatcccgtacgaatacagtaagctcgggatttaccgctatcttgaaagcatcgaagaaaaaaacgcctcactggaatatgtaaacgatgatttagcgttattaaaagccaaagacagagaaagcagcaccgaactgctgaaaacgttagaaatctatctcctcaataactgcaaaacaaaaccagccgcagaacagctttttattcatcaaaacacattgaactaccgcatcaaacagattcttgacatgacatcaattaatttaaacgacttcaggacaaggtgccagctgtatctcgatatcatgctgatgaaaaagagataaaaaagaaaccagtcgccgtactggtttcagttttaataccttcccgcttatcaatctcagaacctcacttctgaatcactcctttcccgcaagatgagaaatgaataaacactgctcctcaatatatgttatactttcattgatattgattctcaattaaaaaagtatgaagtatagatataaacgggaggcagaacgatggcggaaaatcatgaggtgtacgacgtcacgattataggcggaggcccgatcggcctgtttgcggctttttattgcgggatgcgggagctgaaaacgaaagtgatcgagtttttgccgcggctcgggggaaaggtgtctatgttttttcctgaaaaaatcatccgtgatatcggcggaatacccgggattgccggggaacagctgattaagcagctgaaggagcaggcggcgacatttgagccggatatcgtgttgaatcagcgggtggccggatttgaacggctggaagacggaaccattgtgctcgaaagttccgaaggggaaaagcactatacgcgcacggtgattttggccgtcggcatggggacgcttgaggtcaatgaacttgacagcgcggatgcgagccgttattcaggaaagaaccttcattataaggtggagaagcttgatgcgtttcgagataagcatgtcgtgatttccggagggggagataccgcggttgactgggcgaatgagctggaaccgattgcggcgtctgttaccgtcttgcaccgccgtgaggagtttggcggtttggaaagcagcgtggcgaaaatgaagcggtcttccgtgcgggtgcttgcgccgtatcgtctgaagcatctcaacggcaccggggaacggatcgagagcgtcaccgtttgccaaactgagtccggactttctgaagtcatcaagcttgatgagctcattatcaaccacgggtttaaaattgatctcggtccgatgaaggactgggggcttgagatagaagaaggcaggattaaagctgacaggcatatgcgcacgaatcttccgggcgtgtttgtcgccggtgacgccgcccattatgaaagcaagctcagactgattgccggcggtttcacggaggggccgaccgcagtgaacagcgccaaagcctatttggacccgcatgcggatcagatggcgatgtattcgactcatcataaaaaattggtgacacaataaaaaagggctgccccccgatgctgggtccgggggtcagaaaagcattccggcgtatcagctgtgaacgagcatgtctttcatttcatttcgtataaacgcaaataactgttcctgatttttcacggcggtaaacccgcagccggcggggaggtcttcgcccatgcagatgacgggagggcggtttcctctcgggttcggtgatatgccgatttgttttccggcgctgatcaaatgctgagcggattctttgcccgtacagataatcatttgcagaggtgactcactgatcgtgcgttcgatcatggaagtgaatcgctcatccgcgatatgttcatgggtgatataaaacaggcatgattttgagtctggcaagttttctgctgcttgacggctccctacaatgagagaatgcggagaatcattttgccattcggataggagaaagccccgttttgtcagttccgtctttgcggcttcagtcgctgcattcaggcttgcggtcacccggcggatgtcgatctgcttgaaagccagtgtgtcaaagaattcgcataccgcaaggcgtgatgtgaaaaatagttgttcaaaggtgctgatctgtttcaggatgttttcgtttgcgggcatttttttaacgatccgcttcggccattcaataacatcggcgccatactcgcgcagcttgtctgtcaatgtatgttcatcatccccatgagtgaccaccatgatatgccgtccgatgaacggtttgctttcaaaccagctgtgtgtttgaaaattgacaatatcaccgatgacgataatggcagggttggtgatgttttggctttgaactttttcatggatatcctgaagcgttcctttaacgctccgctgccgtccccacgtcccccattgaatgacgagtacgggaacggaaggggattttccgtactccataagcttcctgcatataaatgacagatttttaacgcccatgtaaaacacaagcgtttgaacgcttcgggcaagcccttcccagtcgagattcggcctgccgtgcaatgatgtatcatgagcggtgatcatcgcgaaggacgaagcgaaatcacgatgggtgacggggactcccgcatacagcggcgctgcaattcccgaggtgatgccgggcaccatttcgtagcggatgccgtgctgatgaagcgcctctgcctcttcgccgaccctgccgaacacacttgggtctccgcctttcaagcggacgacggtgtagccctccgccgctttttctatcagcagggcatttatctcagactgtttcataaaatggcggtcgggcagctttccgcaataaatgaaccggcagtccggtgaggcgtattctagaaactttgggtttgcgagccggtcatacaaaatgatatccgctttctccagagcctgttttccttttacggtgatcagccccgggtctcctggtccggcaccgacaaagtatacgattccgtttttcatgatggcgtcatcccttcagcaatttaaaaaatgaaggaccacttggaaaagtgatccggtctttgatcaatacaggaggtatacattctctccttcgatcagtgtttcgtatgttttgacacagccatgatccggctcttggacttttccgtcttctaaggaaattttccagtcatgcatcgggcagaagacgtattctccgctgacgatgccttcagccaggacgccctctttatggggacagcggttttcgacggcgcggacgctcccgtcagaaagcttaaatacggcaagctctttatcttctatatatacggtttttcctaactcctcgggtaattcgtttacattgcctatgcaaacctttgtcatatctttattaaccatgtccgttcccccttactgttttatgaagtcgtgacgacattttcgaatagatctttagaagcttttttatctttaaggaagtattgccacggatctttgtggacagagagtgtctcattcattctgtcgttgagctcctgccgtttttccggatcgtttaatacggattggacatgagataaaccgacgcgctcaagccatgcggatgtccgctccagatagtttgccgtttctctgtagtactgaaggtaagcacccgcgtattctaagacttcttcattcgtttttactttcatcagcaaatcaccggcgcgcaaatgggttccgccgtttccgccgacataaagctcccagcctccgtcgatgccgacaacgccaaggtccttaatgcctgattccgcacagttccgcgggcaggcggacacggccattttaaccttatgaggcgtattgagcccttcgaattttttctcaagcgcaatacccagtgccatggagtcttgtgtgccgaagcggcagaattgttcgcctacgcacgtttttaccgtgcggagtgtttttccgtacgcgtagcctgacggcatatcaagctcggcccatactttcggcagatcttcttttttaacgccgatgagatcaattcgctggccgccggtcattttaacgagcgggatctcatatttgtcgacgacatcggcgatcttgcggagatcttgagagttggttacgcccccgtacatccggggaacgactgagtatgttccgtctttttgaatattggcgtgcatccgttcgttcacaaaacgggatgttctgtcatcctcgtatgtagccggattaatcatgcctaagtagtagttgagggcaggccggcatttggagcagccttccggcgttttccagccgagcacgttcatgatttctctcgtatgtgagagccctttggctttgatttcttctacgacttcatctctcgacagtgaggtgcagccgcaaatcgcttctttttgcgcggatgagtcaaattctgagcccagtgtatattgaagaatgtcttctacgagcggtttacagcctccgcaggaacgggatgccccggtgcatgctttgatttcgtccgttgatgtgcagcctttttcctgaatggcttgaataatggcaccttttgaaacgccgttgcagccgcagatgatttcatcgtcgctcatcgccgcggtcatgcttacgcctgcttcctgatcaagaggctgtaagattgatattttggaggtttcagagatatctgcttctttttgaatcatagaaaacaggcggttgccttcgctgctgtctccgaacaaaacagcgccgacaatttgattgcccctcaggacgatttttttataaatgccgtcctgttcatcgaacacttttattgcctttttgtcctctgattcatcaaagtcgccggcagagaagacctcgacgcctgatacctttaattgagtggagagaacggagccttcgtacggttttgtttcaatgccgcaaatatgtttggccagcacttttgcctgttcatagagcggcgccacaagaccgtacgcgattccgcggtgctcggcacattcaccgaccgcgtaaatgtgcggaatttcagtctgcatataatcgttgacaatgattccgcggtttaccgggatgccgctttctgtgccaagctgtgtattcgggcggatgccgaccgccatgacgaccagatcagcttcgatgcttgtgccgtctttaaagcgtacgccttcgacacggtcagtaccgagaatttcttcggtttgtttttcaaggaaaaatgtcatgccttgtttttctaactcgttttgcagcaggcgtcccgccgctgcgtcaagctggcgctccatcaggaatggggcgaggtggatgacagacacgtccatgccgagattcagcagtccgcgcgcggcttccaaacccagcagtcctccgccgatgacggctgcttttttatattgttttgacgcggcgagcatcgtgtcggtatcttttatgtctcggaatgccgtgacgccttgtttgtctgcgcccggaatcggaaggataaaagggacagagcctgtcgccaggatgagttcatcgtaaggctggattctgtctgcatcggtgatgacggtttggttttccgtgtcgactttgatgactgtttcaccggtatacagctgaatgttgttttctttgtaccagttccaatcgtttaacgtaatgtcttgaatgtcggtatcgccttgcagcacttttgacagaaggattcggttatagttgggatgaggttcggccccgaatattgtaatctcaaattcgtcttttgaaacacgcagtatttcttcaatcgctcttaccccggccattccatttccaacaaggactagctgtttttttcccatcagatgatccgctccttatctttgtttttttcagcgtagcacagcaaaaacaaatatttaagatgcatgttatgaaatgtaacaaaaaatacgaaaaaatctaaaaattttatgaaaattagatagggatgattcgtaccgcacacatcttaaaaccgggcattttacagtccggatccaaggcttcaccaattaaatcgttgacgttttgcgtgtcagaccaatggatggggacaaacaacgtgtgatgtgtctgacttttacttgattttaaacggagaatacatcaaaataaatagtaacgattgcgatttaaaactatgtacatcatgatgaaaataaggcagttgcgagatataaatcgtaatcattctattttatcaggggctattgatatgaaaaaaattccggttacagtattgagcggctatcttggtgccggaaagacgaccgttttgaatcatattttacaaaaccgcaacggtttaaaaattgccgtcatcgtcaatgacatgagcgaagtaaatatagacgcgggcttggtgaagcagggaggcggtttgtcaaggacggatgagaaacttgtagaattatccaacggctgtatctgctgcacgctgcgtgaagatttattagtcgaagttgagaaactcgcgaaagacggcaggtttgattatattgtcattgaatcaacagggatcagcgaaccgattccagttgcccagacattttcttatatagatgaagaaatgggcattgatctgacaacattctgcaggctggacacaatggtgaccgtggtggatgcaaaccgcttctggcatgatttccagtccggtgacagccttcttgaccggaaggaagcggcgggagaagaggatgaacgggagattgccgatttattaattgaccaaattgagttttgtgatgtgctcattttaaataaatgcgacatggtgggcgaaaaagagcttgaacagctggaaacggttcttcgcgcattacagccccgtgccagactgatccggtccgttcgcggagaagtgcccgccgaatgcatattgaataccggtttatttgagtttgaggaagcgagttcatcagcaggatggataaaggaactgacggcaggtcatgaagcgcacactccggaaacggaagagtacggcatcacttcgtttgtgtactcgcggcgtctgccgtttcataccgttcgttttgacagctggctgcatcaatcaatgcctgacaacattgtgcgcgcaaaaggaattgtttggtgcgcaacccgcaacagccttgcgctgctgatgtctcaggcgggtccggcggtttcgattgagcctgtttcttattgggtggcggcaatgccgaaacttgagcaggagcagatcaaaaagcaggaaccggagattctggaagattgggacgaccaattcggagatcgtcatacgaacttggtgtttatcggaacagatttagatgaagccgccattacaaaggaattggatcagtgcctgctcacgcagtctgagttcgattctgattggtcgcagcttgaagatccttttcaatgggatattcagcgggccgaataacataccggccaagtttagaagcaggtgaaaagggaaggagtgatgaaaaaggagctgaccaagtgtgaaagcattgacataccaaggaaaagaacatatggaagtgaaagaagtcccggcacccgccattcaagatgagagagatgtcatcgttcgaatcaccgcaaccgggatatgcggttcagaccttcatttatataaaaacggaatacccgccgatccgggttatattgtcgggcatgagccgatgggaatcgttgaagaaacgggcagtcaagtcaaaaagctgaaaaaaggcgaccgtgtcgtgattccttttaacatcggctgcggagaatgtcattactgcaagcaccagatggaaagccagtgtgatgaatcaaatccaaatcctcatacagatgccggcggtttattcggtttttcggagtttaacggtaattatcccggcgggcaggctgaatatttacgtgttccttttgctgatttctcttcttttctggttccggcagacagtgagcttgaagatgagcaggtgctgcttctgtcagatgtcatgccgaccgccttttggagcgttcagcacagcggagtgaaaaaaggagatacagtcgttattttgggatcaggtccgatcggcttaatggcgcaaaaattcgcgtggaaaaaaggagctaaacgggttatcgcagttgatcaagtcccgcatcgccttgaacatgcgagacgcataaacggagcagagaccttcaatttttcagaacatgatgagatcgggaaactgctgcatgaacaaacgtcagggggcgcggatgtagtgattgattgtgtcggaatggacggcacgccgctttcaaaagaaaaagcagagcaaaaaccgaatcagttcggaacgatcagcccgattcttatagcatcagaagccgttaagaagtttggaaccgtgcagctcacgggcgcatacatttctgaagcggacggctttccgctcggtgatttttttacacgcaacgtttctttaaaaatgggccaggcacccgttattcatctgatgccgatgctgtatcaaatgattgaacaaaatgaaattgatccgacggatatcattacacacaaaatgagtcttgcggaagctcctgctgcatatgatatatttgacaaaaaagaagatggcgacattaaagtgattttgaagccatagcgaggggaaacatgatgaatatttacagaccggcgggattttggatcagattgggagccgttgtactcgactatttaattacttcagtgcctttggcgattatttttatgctggcaacaggaaaagacccgaatgagagcgcaatgatcagcatcattttgactctttatggtattttgctccctgtatactggaacggttatgttatcggcaaaaagatctgcggtatccgcatcgtcaaaaaagacggaaaccaggcaggctttcttactatgattttgagagtgcttgtgggcggcctgatatatggcgtgacgtttggaatcggtgtgatcgtgagcgcattcatggtcggaatgagagaagacaaacggtcaatccacgattttgtagcgggaacgtatgtcacatacgcactgccggacgaatcgattgaaaagagcgaataatttcgctctttttttgcataaaaaatggatgagggagcaacatataacaaacgttaaaggaggaaagagtcatgaaaaaagctgcattgtctttagctgcgtttttcattacagcaatggttttcacaatgccggcacacgccgaaacaaaaatgccttcaacaatgtcactcacggaacagcagaaaaaagaaattgaatcacttgaaaaagaagtgctcgaaaaacgcaaacatgtcatatccaaatatgttgagtacggggtcctgccgaaagaaaaagcagaacatattaaacagcatatggacaggcgctttaatatgatgaaacaaaatggctttgtcccgaagcctccgcctcataaattggaaaagcggcatcatcattcttaagcatccggcaagccggatgcttttttgtttttatcgggattgctctgaaatgcgtttcaaaacgtatgatatcaatatcatacgcatcaggaggatgaaacacatgatacataaaaaacagggtctgttccctgatacatttctatgggggtcagcttcggctgcctatcaggttgaaggagcttggaataagacggtaaaggaccttcagtatgggtgaactgtgcagagaggctattagtgacggagttcatctcatcggctgctgcagctggtcattcacggatctgtttaagctggctgaacggctatcaaaaacgctacggttttgtgtatatcaatcgagatgaagaagatgaaaaagacttgaaacggatcaggaaaacagtttttattggtaccagaatgtaattgaaacaaacggtaaaagtttataaaagttccctgagagaaatatgattctctcaggggtttcttttacattgcgtctgcatcaataatatacgtatccgcatgaagatcggatatttcggcaggcactgaataacaggtaaggctgtatcggcctttcggaatattaaagaaaagccgctttgacatcacgctttcaatctcaattccatcttttacagcctcaaagggaacagtcgcttttttctcataggatagtaccggttcacttgtgttaagcctgaagacgataaatgccctcgtatttctccttgcttcgaatgaaacagctccgtcagcttccgcatatcctttttcaatggcttcatcggtccaatcgataacaggcggttctgaatctttttggaagattgtaaattgatgatacgaaatggccagttcttgcggtttccatgatttattcaatgcgctgttcctcctgtttttttacttgattttaaataatactctcgttccgtcgggatcattggtaagctggtgtccgacccaagagccggctccgcggttgtctgccggagaaatatattctacggaggcattgtttccgccctgtttacaaaccgccatcggccattcatccctatcgtatcccgttttgacaggcacatgtttaagagattgctcacgccgcttatgtactccgtctctgtcaatggtgcatatgctggaatgcccttcttttatcgcgtccttaatatgctttgctgtttccggatatcgatcggacggaaataggattactttgtcgtaatcactcttctgaacggtctgctcgttatctgagaaaagatcacccttgatcagggccgcgactgctccggcaatgatgataagaacaagcagcagtgcttttaatgttttcaagagtatcaatcacctccagttttaaattgctgtaaagctggtccaagaataaagcagaatcggccggctgtaaagctgttaaaatatatttctcagccgcaattcagctgaatatctgtaaaaccatccgcacaaatcaattttattcattaaatatccgatcagaaagtgttttttgccgtttccctattcagaaatgaacggttgcggccgtatcgtcaattgacttattatagcgataagctcaccggcaggatatcttcgtctgcgagtgtccgacccgaaaaccttggcctgcatgaccgtgcgcaacaagacgataaaaagacggccatctgataagaaggccgtcagtaaatcattccagattcgcatgctttgtaaacatgtctgctgaattcagttcttttttctccatgatttttagaataaccgcatcgtaaaacagcagaagagtttgttcgaataaagaacccatcggctgaatcgtctttctgtctccgccggtctcttccttaggagagccgggaatcgttatcgtaagatccgcaagtttgccgagacttgaatcggggttaatcgttaatgcagtgatgatgccgttaaggcttttggctttttcagctgtatgaagcagactttttgtttcgcctgagcctgagccgatgatgacgagaccgccttcttggaggggaggggtaagcgtctcaccgacgatgtaagcgttcaggccgatgtgcatcatcctcatggcgaacgctttagccataaagccggaacgccccgctccggacgtgaagatttgatctgccgataaaatctcatctgcaagcttgtcagcttcactgtcggctattaatgctgcggtgcgggatatttcattgagtatttcatgtaagtattcagtcgttttcatgatccttgtgaaatcagctgtttcattttagcagcagcatccgctttattgtcagctcccgtaatgcctccgccgacaatgattaaatctgggttttgtttgatggcttcaggaagcgtatcaagtttaatgcctccggcaattgcggttttagcgctcttgaccgcttttttaatcgccgtcagttcctcgaatgaattctttccttctgcttgaagatcataacctgtgtgaacacaaatataatcaacaccgagttggtcaatttcttttgcccgtgtttcaaggttttttacgttaatcatgtcgacgagaattttttctgctgtttttttgcttcggcaaccgcccctttgatcgttgagtcgtctgtcgctcctaaaacggtgatgatgtcggcgcccgcttctgccgctttcatgatctcgtagccgcctgcatccatgattttaagatcggcaagcactttcaggtgaggaaaggctgatttcatttcctgtacggctttcaggccttcattaatgacaacgggagtgccgatttctacaacatctatatattgttcgacctctttcacaagttcaattgcttccgggatattcactaagtctaatgccagctgtaattccactttatatccactcctctttttcatgtatttacattctatagagtgccccgcatgttgagaagtacgcactttgaagtctaatagttactttgaggatactgtccccgcaggcaatgcgctttgtttcagcaaaactgcgtggtagtataaactgatgaaagttgtgtaaaaaagtaagcgtgtatgaatagatgatgaacgtacaaaaagtaagaggaaggagaatggcccgtgagccgaatggatgagaaaacgtttaattgcgaaaaggaattgacgcttgccgtgataggcgggaagtggaaaatgctgattatgtggcacctgggaaaagaaggaacaaagcggtttaatgagctgaaagctttaattccggatattacgcacaaaattcttgtgaatcagctcagggagctggagcaggatctgatcgttcacagggaggtttaccctgtcgtccctccgaaagtggagtactcattaacggagcaaggagagacccttatgccgattttggacgccatgtataagtggggaaaagaatatatggaattaatcaacattgataaaactgcaataaaggaatctttttgaagcgctctatgtaaaatagagtgctttttttgcggtttaatgaaatcatattgcgaacgattaaatctcctgtttcggttcttgcgctgttttttccccatcagctcatatatgaaaactattttcattctgccataactggatattcgagagatttatactatagtttaaagatttttaattttacataaataatatttttaaaaataaattgcgggatgccgcaaaataccctctggaattgtcggaatttttttcggtgtgccgaatgaaacttttcacccatttttcggtgataaaaacaataatttcatataaagtgaacgtaagtagatatatagtaattcatgaagaaataggtaaaccctgttgcttacaaacattggattcttgtcttgatttctcataaatttgagccgcatttcggactgtgcgggtgagtggattgcggatttcggcggtgattgaatcgggatcgttttggaggtaagtggttcttttggcttgataatgagttagggacattgagggaggctgtttctaagggagaattgacaattttatcttaaaaaggggaggcgcacacatatggaaataactttttatcctttaacaaatgctcaaaaacgtatctggtatacagaaaaattctatccgaacacaagtatttcaaatcttgccgggttcgggaaactcatttctgacgacggcgtacaggctcattacgttgagaaagcgatacaggaattcgtccggcggtatgagtcgatgagaatccgtctgcggcttgatgatgagggggagcccgttcaatatgtgagcgattaccgtccgctgactatcgaacatacagacatcaggcaagccggctgctctgcggaagagctgtcaaaatggggacgtgacgaggcaagcaagcctctggcattatatgatcaggatttattccgtttttccgtgtataccatcagcgaaaatgaggtctggttttacgttaatgtgcatcacattatttcagacgggatttccatgacgattctgggcaatgcgattactgatatttatttggagctttcgggcggagcaagtatggaacagacggagattccttcctttatcgagcatgtgctgactgagcaggaatatgtgcagtcgaagcggtttaaaaaggatcgggatttttggaacgggcagttcgagaccgtgccggagcttgtgtccctgaaacggagccaggcagatgcgggtcttgatgcgaaacggttttctcaagaaattcctcacgacttatacggccgcattcattcattctgcgaggagcataaagtcagcgtactatctctgttccaatcagctttgatcacttatctctacaaagtgaccggccgggatgacgttgtcacgggtacgtttatgggaaaccggacgaatgcgaaagaaaagcagatgctcgggatgttcgtatctacggttcctgtgcggacaagcgttgacggaggacagtcgttcttggaattcgttaaaggccggatgaaggatctgatgaaaattctccgccaccaaaagtatccgtataacctgcttgtcaatgatttgcgcgcttcgaaaagttcgctgagcagattgtttacggtggctctggagtaccaggtgatgcagtggcagaaaaaagagaatctgtccttcctgacagaccctattttcagcggaagcggtacaaatgatatttcgattcatgtgaaggaacgatgggacactgggaaattgacgattgattttgactatcgcagcgacatattcaagggagaggagattgtatctgtttctgaacgtttgatcacgctgattgaagatgcgatttcatctcctgatcgcataattgatgagcttactcttctttctgaatccgagaaagagcggctgctgacacgggcctccggtaatccggtgaattaccgcggggagatgacgataccggggctgtttgaagagaaagtgaagtcactgtctgacaaaccggcggtggtgtatgaaggccgaacattgtcctatcgcacattgcatgaacagtcaggccgaattgccggacgccttcttaaagccgggatatcagccgattctcctgtcgcggtgctgcttggccgttctgagcgtgttattgcggcaatattgggaattttgaaagcgggcggcgcctatgtgccgatagatcctgactttccggcggatcggattcagtacattttggaggacagcggagcgaaggctgttctgacagaggccggaatacaggcgcctgcagcggatgccgaacggattgattttgacgaggctgttcagtttgaaacggctgcggacggtgtcagtacacaatcagaccggctggcttacatcatctacacgtcaggtacaacggggcggccgaaaggcgtgatgattgagcaccggcaagttcatcatctggtgcaatcactgcagcaggagatttatcaatgcggtgagcagacattaagaatggcgcttttggctccgtttcattttgatgcgtccgtcaaacagatttttgcctcgcttcttttgggacagacgctttatatcgtgccgaaaacgactgtaacgaatggctcggcactgctggactattatcgtcaaaaccgaattgaagccactgacggaacccctgcgcatctgcagatgatggttgcggcgggagatgtcagcggaattgaattgcgccacatgctcattgggggagagggcctgtccgccgctgttgctgaacagctgatgaacctctttcatcaatcgggcagggcgccgcgtctgacgaatgtctacgggccgacagaaacgtgcgtagatgcgtccgtgcatcaggtgtccgccgataacggaatgaatcaacaggcggcgtacgttccgatcggaaaaccgctcggcaacgcccgtctgtatatattggataagcaccagcggcttcagcccgacggcacggccggtgagctgtatatcgcgggtgacggtgtaggccgcggctatttaaatcttccggatttgaccgcagagaagtttttgcaagatccgtttaacggaagcggccgcatgtaccgcacgggtgatatggcgcgctggctgccggacgggacgatcgaatatatcggacgtgaagatgatcaggtgaaagtccgcggctaccgtattgagctgggagaaattgaaacggtgctcagaaaagctccgggggcggcgcaggccgtcgtgctggcacggccggatcagcagggcagcttagatgtttgcgcatatatcgttcaggaaaaaggaaccgagtttcaccctgccgagtacagggagtatgtgtccaagcaccttcctgattacatggtgcccgcttactttacaaaaacggacgaaattccgctcacgccgagcgggaaggcggaccgcaaaaagctgtttgcgcttgatgtgcaggctgtcagctcatccgaatatgccgcgccgagaaacgaaacggaggaaacgctcaccgtcatctggcaggaagtcctcggaatggacaaggcgggcatttatgatcatttcttcgagtcaggcggtcattcattaaaggcaatgacgcttctgacgaaaattcataagcaaatgggcgttgaaattccgctgcaatacttgtttgagcatccgacgattgcggcgcttgccgattatgcggaaaaccgaaacgaaggaccggcattcagggcgattgagccggctgagaagcaggcgagctatccgctttcgctcgctcagcagcggacttatatcgcgagccaatttgaagatgcgggagtcggatataacatgccggctgcggccgtgattgagggcgctttagaccttgaaaagctcgagcgtgcattttctgccttaatcagcaggcatgaagcgctcagaacatcgtttcaatcggaggacggcacgccgagacaggtggttcacgaacatgttccgtttcatattgaaatgctcgaagcgcgcggaagaacgaatgaacaggtcatgaaggactttgtgcgccgttttgatttatctgaggcgccgctgttcagaatcggcctgcaaacgctcggtcacaatcgccatatgctgctgtttgatatgcatcacctgatttctgacggggtgtctatttccatcatgctgaaggaactggctgacatctacggcggaaatcagctgcctgaattgcgcattcaatataaagattatgccgtatggcaggcggaacgggcgaaagaaggctacaagaaggagcgggcgtactggaaagaagtcttcagcggcgaactgccggtgcttcagctgctccctgattatccgcggccgcaggtgcaaagctttgaaggtgaccgcgtgtccgccaagctgccgaaaatgctgcgggaacggctgcagaagcttgccgagaaaaacggagccaccctttacatggtgctgttatcggcatactatacgctgctttctaagtattcgggacaggaagacatcatcgtgggaacaccgtcagcgggaagaaatcactctgataccgaggggcttatcgggatgtttgtcaacacgcttgcgctgcgaagctccgtgaagcaggatcagacatttgccggcttgttaggtcatgtgcgcaaacaggtgctggacgcgttttcccatcaggattatccgtttgagtggctgaccgaggagctgaacgtgccccgggacatgagcaggcatccgatatttgacacgatgttcagtctgcaaaatgcttcggacggaattccggagatcggcaacctgacgctgtctcttcatgaaaccaacttcaatatcgctaaattcgatctgacaatgcaggcccgggaaacagcggaaggcattgcgctcgatttggattattgcacgaagctgtttaagcgctcaactgcggatcgcatgcttgcgcactatgtccgtctgctggagagtgcggcagctcagccggatgcgaaaatcagcgaatatgatctgctttctgaacgggaggctttgaaccaattacagcggttcaatccggagcgcacggcatacccgaaagagcaaacgatcgtgcagatctttgaagaacaggcccgaaagaaccctgaccggacggctcttcagttcgaaggggaaactctgtcgtatcagcagctgaatgaacgcgccaacaggcttacgcggcatattctttcggtcggaggcggcgggaaaaccgcggctgttttatgtgaacggtcaatggacatgattgtttccattatggctgtgttaaaagcggggtccgcctatgtgccgattgatcctgagcatccggttcagcggattcagcatttcttccgcgacagcggggcgaatgtgctcctgactcagcaaagcctcaagccgcttgcggaaaaggccggttttcaaggcgtcattgtgcttgctgatgatgaggcgagctatgaaaaggactctcgcaatccagcattgccgtttgattccaaaacgattgccaatctcacgtatacatcaggcacgacgggaacgccgaaaggaaacatcgtcacacatgccaacattttgcggacggtaaaaaacacgaactatttgaccgtttctgaagaggacacagtgctcggtctgtcaaactacgtctttgacgcttttatgtttgatatgttcggttcgctgttaaacggtgcaaagcttgtgatcgtcccgaaagatacggtgctggacatgtcgcgcctgtcccgtgtgatcaaacgggagaacgtcagcattctgatgattacgacggccctgttccacctgcttgttgatatggagccgtcctgtctgacgacgcttcggaaaatcatgttcggggcgaaagagcgtctgtagaacatgtcaaaaaggcgctggcggcagtcgggaaaggaaaactgcttcatatgtacggtccgtcggaaagcacggtgtttgcgacataccatccggtggatgtcattgaagaggatacgctctccgttccgatcggtaaaccggtcagcaatacggaagtctttattatgaactcagccggacgcattcagccggcgggtatcgcgggagagctgtgcgtcagcggggaaggtctcgtagaaggctactacaaccgtcctgaactgacggaagaaaaatttgtaaagcatccgtttaaggaaggtgaacggatgtataaaacgggcgacttggccagatggcttccgaatggcgatatcgagtttatcggacgcatcgaccatcaggtgaaaatccgcggtcagcggattgagcttggcgaaattgagcatcagcttcaaagccatgatcagattcaggaatgcattgtgctcgctgtggatcagggcgcgggtgacaaacttctttgcgcgtattttgtcggcctcagggaaatatcttcccgggagctgagggagcatacggcgaaggatcttccggcttatatgattccgtccgtctttattcaattggatgaactgcctcttacagggaacggaaaaatcgacaggcgggcgctgccgatgccggatgtgaccgcagcgaatgccgtgtcatatacggcgccgcgcaatgaaacagaacaaaaactggcggatatttgggctgaggtgctgcaaatggaacgggtcggcgtccatgatcagttctttgagatcgggggccactcgttagcggggatgaaactgctggcccttatccagaagacattcggcgtgcagcttaccttaaaggatctgttcacttctccgacggctgctgggctggcgcagctgattgaaggggctgagcggaaggcggctgagagcatcgcaccggctgcggagcgggaaacgtatccggtttcttcaccgcagaagcggatgttcgtgcttcagcagctggaaggcgctgaaacaagctataacatgccgtctgtgctccgtttaaaaggaaagcttgatgcagaaaagctgaaatccgtcatgaaacagctgacagaacgccatgaagccttcagaacgacatttgacataaaggatggagaaacggttcagcgtatatgggcggaagcttatatcgacatggaatattatgaagcctctgaagaagatgctgaacggattattcagagctttatccggccgttccgtctggatcagcttcctctcgtcagaacggggctggtcaagctggctgaacatgaccacctgctgctgtttgatatgcaccatatcatttcggacggcgcttcagtcggcgtgctgatagatgaactgtcccgcttgtatggcggcgaaacgcttgagccgctgcggattcattataaagactatgcggtatggcagcagaaatttattcaatcagagcagtaccgcaagcaggaggagcattggcttcgggagcttgacggcgagcttccggtattgacgctgccggctgattacagccgtccggccgtgcaaacctttgaaggagacaagctggtcttttctctgactgaggaacagacgtcggctcttcgcagtcttgcgaaacaaacggattctaccatgtacatggtgctgctggcgtcgtacagcgcctttctctcaaaactgagcggacagcatgacatcattgtcggctcgccggttgcgggacggtcacatgcggatctcgcaaacgtcatcggtgtttttgtgaatacactcgcgctgcgtacgtatccggaagcggacaaaacgttcacggactatcttaaagaagtgaaacaaaccgctttacatgcatttgacgcgcaggattatccgcttgaagaccttctgcaaaaggttgaggtgcagcgtgatacgagccgaaatccgctgtttgatgcggtattctcaatgcaaaatgcaaatgctgaagatctggtcatggaaggaattgagctgaagcaccacccgtttgacagaaaaacagccaagtttgacctgacgatgacggctgaggacacagacgaaggcttaacgtttgtgcttgaatataacaccgcgctgtttaaaccggaaacggcagagacgtggaagcattattggcttcaactgttaaaagccgcaacggaaaatccggctgcgaagctttctgagctttccttggtgaatgaaacagaaaaacaagccctcctcaatgcatggaaaggaaaaacaatttctgtgccgcaggacaaaacggttcaccgtctctttgaagaaacggccgcccgatacgcgaaccggccggccgcggcatataacggcgcgaaatggacgtacggcgagctgaacgcaagggcgaaccggatcgcgcgcattctcatagactgcggcgtcacggctgacgaacgtgtcggcattttgacgaaaccgtccttggaaatggccgcgggcgtactcggcgtcctgaaagcgggcgcggcatttgtgccgattgaccccgactacccacaagagcggatcagctacattctgcaggacagcggcgccaagcttcttctcacacaggaagcgctggacgtaccggatggctacacaggagatacgattctgcttgacggcggacgctccattctgagcctgccgcttgatgaaaacgatgaagcgaacccgcagactgaaacaacggcggatcagctcgcttatatgatttacacgtcaggaacgaccggacagccgaagggtgtcatggtcgaacaccatgcgctggtgaacctgtgcttctggcatcacgacgcattcgccatgacggcggatgataaaagcgccaaatacgcgggctttggttttgacgcctccatctgggagatgttcccgacatggaccatcggcgcggaacttcacgtcattgacgaagcgatccggctggatatcacccgcttaaatcactatttcgaggagcacggcgtgaccatcaccttcctgccgacgcagctggccgaacaatttatggagctggaaaatacctctctccgcatgcttctcgtcggcggcgacaagctgaagcgggcggtgaaacagccgtacacgatcgtcaacaactacggcccgacggaaaacaccgtcgtcgcgacaagcggcgtcatcaatcctgaggaaggatcgctttcgatcggacgggcgattgccaatacgagagcttatattctcggcgacggcgatcaggtgcagccggaaggcattgccggtgaattgtgcgtggccggccgcggtctggcacgcggatacctgaaccgtgaggaagaaacggcgaagcggtttaccgcagatccgttcgtgcccggcgagcgcatgtaccggaccggcgacctcgtcaaatggaacgcgcagagcggcatcgaatacatcggccgtatcgaccagcaggtcaaagtgcggggctaccggatcgagctttcagaaatcgaagtccgcctcgcccagcttgcggacgttcatgacgcagcggtgacggcggtggaagacaaagcgggcaataccgcgctttgcgcctatgtcgcgcctcggcaggacgatattgaagcgctcaaagccgcgctgaaagacacgcttccggactacatggtgccggcgttctgggtggagatggacgagcttccggtcaccgcaaacggaaagattgacaaaaaagccctgccggaaccggacattgaagcgggaagcgccgcttataaagcgccggaaacggagatggagacgctgctttccgacatttgggaggaagtgctcggtcttgatcagatcggcgtaagcgataatttcttcaccctcggcggcgactcgatcaaaggcatccaaatggcgagccgcctgaaccagcacggctacaagctggaaatgaaagatctcttccagcacccgaccatcgaagagctcgtctcttatgtggagcggacggaaggcaagcaggccgatcagggacctgtcgaaggcgaagcggagttaacgccgatccagcgctggttctttgagaaaaacttcacggacaaacaccactggaatcaatccgtcatgcttcatgcgaaagacggctttgatccggagataacagaaaaaacattacatgtcctgacggtgcaccatgatgcgctccggatgatttatcgtgaacaaaaaccgtattacagagggcttgaggatgcgtctgttgaactgaacgtctttgagctgaacggacctgctgaagatcatgaggaccgtatcgaacgggaagcagaccgtcttcaaagcagtatttcactggaaacaggacatctgctgaaggccgggctcttccgggctgaagatggagaccaccttcttctcgcaatccatcacttagtcgtggatggtgtatcttggcggattttactggaggacttcacgtccgtttatacgcagctgaaacaaggcaatgaaccggcgctgcctccgaaaacacattcattcgccgaatttgctgagagaatcaaagaatacgcaaatacgaaggcgtttctgaaagaagcggattactggagggggcttgaggagaaagaggtatgcactcagcttccgaaagacaggcagtctggcgatcagcgcatgagacatacgagaacggtcagtttctctctgacgcctgaacaaactgaacagctgacgacaaacgtacatgaagcctaccatacggaaatgaacgacatcctgctcacggcgctcggactggcgctgaaagagtggacgggtgaagacacgatcggcgttcatttggaaggccacgggcgcgaagacattcttgacggcctgaatatcacccggacggtcggatggtttacgagcatgtatccgatgatccttgagatgaagcacgccgacgatctttcatatcagctgaaacaaatgaaagaagacatcagacacatcccgaacaaaggagtcggctacggcattctgcgttatgtaacggcgcctgagcataaagagggtctttcatttgagattgatccggatatcagctttaactacttaggccagtttaatgagatgtcggattccggcttatttacaagatccgggatgccgtcaggacaatcgctgagccctgacacagagaagccgaatgcgcttgatattgtcggatttatagaaaatgggcagatgacgatgacgtttgcctatcattctctcgaatttcatgaaaaaaccattcaatcgttcagtgacagctttaaagggcacctcttgaaaatcatagatcactgcctggcccaagacggacctgagcttacgcctagcgatcttggcgatgatgatctgacgcttgatgaacttgataaattaatggaaattctctaacagaaaagacagaggtgacatatgagcaaaaaatcgattcaaaaggtgtatgcactcacaccgatgcaggagggaatgctgtatcatgcgctgcttgatccgcattcttcctcctacttcacacaattagagcttaggattcacggaagctttcagcttgagctttttgaaaaaagtgtcaatgagctgattcggacatatgacatcctgcgtacggtattcgtgcaccagcagcttcaaaaaccgcgccaagtcgtattagcagagcggaagacgaaggtgcactatgaagatatcagtcaattagatgaagcgcgccaaaccgaatatattgaacgctataaacgcgatgtgcagcagcagggctttcatctggcgaaggatattctctttaaagcggcggtgttcaggctcagtgagaaggaactgtatctcgtctggagcaatcatcatatcgtcatggacggctggagtatgggcgttttgatgaaaagcctgtttcaaaactatgaagcgcttcgtgccggccggcccgccgggggaagccagggcaaaccttactctgactatatcaaatggctcggaggcagggattatgaggaggcggaacaatattggagcagccgcctggcggatttcgaacagccgagcctgctcccgggccgtctggcatcagaaaagaaagactaccaaaatgaagaatattcttttgtctgggatgaagagctggtcgcgcagattcagcagaccgccaaccggcatcaagtcacggggcctaacctgtttcaggccgtttggggtgcggtgctcagcaaatacaactatacagacgatgtggtgttcggcaccgtcgtatcaggccgtccttcagaaatcaacggcattgaaacgatggcggggctgttcatcaatacgattcctgtcagaatcaagattgacaaagatgcagccttttctgacgtgatggcggcagttcagaaaaacgccgtggaagccgagcgctatgattatgtgccgctctatgacattcaaaagcgctccgctctggacggcagcctcttgaatcatttggtcgcgtttgaaaactatccgctggacaaagagctggaaaacgggggcatggaggaaagactcggcttttccattaaagttgaacatgcttttgagcagacgagctttgatttcaatctcatcgtgtatccgggaaaaacgtggaccgtcaaaatcaaatacaacggagcggctttcgcacatgatgccatcgaacgaacggcgcaccatctgacctgcatgatgaaagcggcggtcggaacgcctgacgcgcccgtgcgggaactcggccttgtttcaggcgaagaagagcggcagattgttgagatattcaatgatacgaaaacggcgcttccggaagaggaggccgttcaccgtttgtttgaagcacaggcaaaccggacgcctgcaagcatcgcgataaaagaagagggacgcgaatggacctaccgtgaagtgaacgaagcggccaaccgcctggcgagacaccttgtgaagagcgggctggaaaaaggccggaccgccgctattatgaacgaccggtctgcggaaaccgttatcggaatgcttgccgtcctaaaagcaggcggcgcctatgtgccgattgatccggcttttccggaggaccgtctccgctttatggcggcagacagctcgattcggctcgtgctgacagttcaggactatcaagaacaagcgggcacattgcaagtcccgattgtcatgctgaatgaaagcgcggatgaaacggtaagcggaacagacttgaatctcccggccggcggcaacgacttggcgtatatcatgtatacatccggatcgaccggcaaaccgaaaggcgtcatgattgaacacagaaatatcatcaggctcgtcaaaccttcgaattacgtgccggttcatgaagaagaccggatggcgcaaacgggagccgtcagctttgatgccggaacctttgaagtcttcggcgcattgctgaacggagcggcattgcacccggtgaaaaaagagacgctgcttgacgccggacgattcgcccaatttctgaaagagcagcggatcacgaccatgtggctgacgtctccgctgtttaatcagcttgcccaaaaggatgccggcatgtttaacacgctccggcacctcatcatcggcggtgatgcgcttgtgccgcatatcgtcagcaaagtgaggaaggcatcaccggagctgtcgctttggaacggctacgggccgacggagaatacgacgttttcgacgagttttctcattgatcaggactacgacggttcgatcccgatcgggaagccgatcggaaattccactgcgtacattatggacgaaaaccgcaacctccagccgatcggcgcgcccggggagctgtgtgtcggcggaagcggagtggcaagaggctatgtgaatctgcctgaattaacggagaagcagtttgtccgcgatccgttcagaccggatgaaacgatataccggacgggggacttggcgaagtggcttccggacggcacgatcgagtttctcggcagaattgacaaccaagtaaaggtccgcggtttcagaatcgagctcggcgaaattgaggcgaaaatcagccaggcggagaatgtgacggaatctgcggctgtgatccggaaaaataaagcggatgaaaatgaaatctgcgcttactttaccgcagaccaagccctttcgccggaagacctgcgcaaaacgctttcggaatcacttccggaatacatgattcccgcgcacttcatccagatgaatcagtttccgctgacggcgaacggaaagattgataaaaaagcgctgcctgagcctcaggctgaagccgttcaaaaagaatacgaagcgccgaaaacggaagcggagcagaaactcgcggacatttgggaaggcattctcggtgtaaaagcgggtgtgactgacaatttcttcacgattggcggacattctttaaaagccatgatgatgaccgctaaaatccaggagcactttcaaaaagaagtgccgattaaagtgttatttgaaaagccgaccattcaggagcttgcgcattatttggagcatgagaccgaggaggaacagcagtttgaaccgatccgacaagcgccttatcagaagcattatcctgtttcctcagcacagcgcaggatgtatatccttaatcagctcggacaggccagcacgagctacaacgtccctgctgtacttctgctggaaggatcagtagacaaaaaccgtcttgaagaggccatgcaggcattaatcaaccgtcatgagacactgcgtacgtcgtttgacatggcagatggagaagtcgtgcagaccattcataaaaatgtgtcgtttgagcttgaaaccgccgagggccgggaagaagatgcagaagagctgacaaaagcctttatcaggccgtttgcgctcaatcgtgcgccgctggtccgttcgaagctgatccggcttaaagaagaccggcatcttctgctgattgacatgcaccacattattacggacggaagctcaatgggcattttcatcggtgatcttgcgaagctttatcaaggcacggagcttgagctgccaaagattcattataaggatttttcagtctggcagcgtgaaaaagcaaatcttgatcagcacgaagcttactggcttgatacgttcaaaggcgatctgccggtgctggatctgccgcttgatttcccgcgtcctgccgagcgcagttttgaaggggaacgcgtcatcttcgggcttgataaacaggtgacggcgcagattaagaagctgctggctgatacggatacgacgatgtacatgttcttgttagccgcttttcaagtgctgctgtccaaatattcggggcaggaagacatcatagtcgggtctccggcggccggaagacagcatcctgatctccaagacgtgccgggcatgtttgtcaacacagttgcgcttcggtcgcatcctgccggcaaaaaaacgttcaagcaatttctggatgaagtgaaaacggcgagccttcaagcttttgagcatcaaagctatccgcttgaagaattaattgaaaaactgccgttaacgagggacacaagccggagtccgctgttcagcgtgttatttaatatgcagaacatggagatcccggccctgcggctcggagatttggagatttcttcttactccatgcatcatcatgtcgctaaatttgatctttccttagaagcggctgagcgcggagaagaggtcggattgagctttgattacgcgaaagccttatttgcggacgaaaccatccgccgctggagcgctcattttgtcaatctgattaaagcctgcgccgaaaatccggatattcagctggccgacgcaagcctgctgtccgctcctgagcgggaagcgctcctttctgatgaaaaacggacggaagcggatctgcctgagggcacttttgtttcgctgtttgaacggcaagcgcagaaaacgcctgatctcacggcggttgcgggcggaacaagtctgacatatcgtgagcttgatgaacgctcgaaccggtttgcccgacaccttcaggcttgcggaacgggcagtgaggacatcgtggccattatgatggatcgttcggccgacttgattaccgcgattctcggcgtcatgaaagccggagcggcatttctcccgattgatccggagactcctgaagagagaatccgctactctctcgaagacagcggaacgaagcttctggtcgtcaatgagagaaacatgaccgcggccgccgtttataaaggaaaaacggtcgtaatggaagacggagaatggcagaacgaaagcgccgaccggcttgaaacggagtccggcgccgaccggcttgcctatatcatttatacctcgggaacaacgggcaaaccgaaaggcgtccagctggaacaccgcaatctaatcaattatgtcacatggttcagccgtgaagccggtttgaccgaagctgacaaatccgtgctgctgtcttcttacgcatttgatctcggctatacggccatattcccgattcttcaggcgggcggcgagctgcacattgtgccgaaagagacgtacaccgcgcctgatcagcttggtgagtatatacagaaaaacggcattacgtatatgaaactgacgccgtcattgttccatatgatcgtcaatacagcccgttttacgtcagaacgccgtttcagctcgcttcgtttagtggtgctcggcggagaaaagatcatcacgtccgatgtccgcaagtttcatgacgtatacgcccataccgacttcatcaatcactacgggccgacggaaacgacgatcggcgccattgcggaacggatcaatatggagcgtcttgatcaatatgagcagcgtcccgtcatcggccgcccgatcgcaaataccggcgcgcttgtattggacggagcaatgcagctcgttcctccgggcgcaagcggcgagctttatattaccgggaaggggcttgccagaggatatcttcaccgtccgcagctgacggcggagaaatttctctcaaaacctttttcaccggacagcctgatgtacaaaacgggagatatcgtccgcaggcttcctgacgggacgattgaatttatcggccgtgcggatgatcaggtgaaaatccggggctaccgcattgaattaaaagaggttgaaaccgtgctgttaagcgtaaacggcattcaggaggcggtcgttctcgcagtcagcgaaggcgggctgccggaactgtgcgcgtactataaagccgacagcgggctgaaaggctctgagcttcgcaaacggctttccgaaacactgccgtctcatatgcttccggcctatttcgtgcaagtagaccgcattccgctcacagccaacggaaaaaccgataaaaacgccctcccgaaaccgggcgtcagccaaacggcgcaaattgcttcagccttgccggaaacggaattggaggaaaagctgtgccgcatttggaaacagacactcggtacggatacgctcggcatcgacgataatttcttcgattacggcgggcactctttaaaaggaatgatgctcctcgccaatattcaggctgaactggacaaaacggttccgttaaaagcgctgttcgaacagccgactgtccgcctgcttgccgcatatatcgaaaaatcggcggtatctgagggatatcggatgatcacaccggcagacagtgcagacgcgtacccgttatcatccgcccaaaaacggatgtacgttctgaaccagcttgaccgggagacaatcagctataatatgccgtccgttcttctgatggaaggagaagtcaatatttcaaggcttcagaaagcgctcaatcagatgatcaaccgccacgaatctttgcggacgtcctttatcgatcaaaaaggccagccgatgcagcagatcgcagaacaggctgacattgacctgcacatttttgaagcagcggacgaggagaaggcggatcttatcattcaggcattcattaagccgtttgatctgagcgcggctccgctcattcgggccgctcttgtcagactgaatgaaaagaaacacctgctgctgctggatatgcatcatatcattgccgacggcgtgtccagaagcatgctggtcaaagagctcgctcacctttacaaaggcggaagtctgccgtcgccgaacctgcactataaagacttcgccgtctggcagaatgaacccgggcaggccgaacggatgaaagaccatgagcgttattggctctcggcattttccggcgagcttcctgaattgaatctgccgaccgattttccgcgtccgccggttcaaagttttaaaggacaatccgtccgtttcagagcggggcgtgagacggaaaaagcggtgcgtgaattaatggaatcatcgggagcgactcttcatatggtgcttcacgccgcgttccatgtctttttgagcaaaatcacgggacagcgcgatatcattatcggttcggtgaccgcgggaagaacgagcgccgaagttcaggaaatgccggggatgtttgtcaatacgcttgcgcttcgcaatgaaacgcaaaaagagcagaccttcgccgggctgctcgaacgggtgaaacaaaccaatctcgacgcgctggcgcatcaggattatccgtttgaggatctgatcggaaagcttgacctgccgagagatatgagccgcaacccgctgttccaggtgatggtgacgacagaagatccggataaagaaacactggaactggagaacctgcgcatcactccgtatgagtcaaaccaaggcacggcgaaattcgatctgacactcggcggctttacggatcaagaaggtctcggccttcagtttgaatatgcgactgatctgtttaaaaaagaaaccattgaaaagtggagcgccgggttcctgcggattctgaagcaagcggcggaaagcccggacagaaagctgcctgagatttcactgatcagcgatgctgaaaaacaagccctccttgacgcatggaaaggaaaaacactctctgtgccgcaggacaaaacggttcaccgtctctttgaagaaacggccgcccgatacgcgaaccggccggccgcggcatataacggcgcgaaatggacgtacggcgagctgaacgcaagggcgaaccggatcgcgcgcattctcatagactgcggcgtcacggctgacgaacgtgtcggcattttgacgaaaccgtccttggaaatggccgcgggcgtactcggcgtcctgaaagcgggcgcggcatttgtgccgattgaccccgactacccacaagagcggatcagctacattctgcaggacagcggcgccaagcttcttctcacacaggaagcgctggacgtgccggatggctacacaggagaaacgatcctgcttgacggcggacgctccattctgagcctgccgcttgatgaaaacgatgaagcgaacccgcagactgaaacaacggcggatcatctcgcttatatgatttacacgtcaggaacgaccggacagccgaagggtgtcatggtcgaacaccatgcgctggtgaacctgtgcttctggcatcacgacgcattcgccatgacggcggatgataaaagcgccaaatacgcgggcttcggttttgacgcctccatctgggagatgttcccgacatggaccatcggcgcggagcttcacgtcattgacgaagcgatccggctggatatcacccgcttaaatcactatttcgaggagcacggcgtgaccatcaccttcctgccgacgcagctggccgaacaatttatggagctggaaaatacctctctccgcatgcttctcgtcggcggcgacaagctgaagcgggcggtgaaacagccgtacacgatcgtcaacaactacggcccgacggaaaacaccgtcgtcgcgacaagcggcgtcatcaatcctgaggaaggatcgctttcgatcggacgggcgattgccaatacgagagcttatattctcggcgacggcgatcaggtgcagccggaaggcattgccggtgaattgtgcgtggccggccgcggtctggcacgcggatacctgaaccgtgaggaagaaacggcgaagcggtttaccgcagatccgttcgtgcccggcgagcgcatgtaccggaccggcgacctcgtcaaatggaacgcgcagagcggcatcgaatacatcggccgtatcgaccagcaggtcaaagtgcggggctaccggatcgagctttcagaaatcgaagtccgcctcgcccagcttgcggacgttcatgacgcagcggtgacggcggtggaagacaaagcgggcaataccgcgctttgcgcctatgtcgcgcctcggcaggacgatattgaagcgctcaaagccgcgctgaaagacacgctgcctgactacatggtgccggcgttctgggtggagatggacgagcttccggtcaccgcaaacggaaagattgacaaaaaagccctgccggaaccggacattgaagcgggaagcgccgcttacaaagcgccggaaacggagatggagacgctgctttccgacatttggcaggaagtgctcggtcttgatcagatcggcgtaagcgataatttcttcaccctcggcggcgactcgatcaaaggcatccaaatggcgagccgcctgaaccagcacggctacaagctggagatgaaagatctcttccagcacccgaccatcgaagagctcgtctcttatgtggagcggacggaaggcaagcaggccgaccagggacctgtcgaaggcgaagcggagttaacgccgatccagcgctggttctttgagaaaaacttcacggacaaacaccactggaaccaatccgtcatgcttcacgcgaaagacggctttgatccggacctggtggaaaaaaccctgcaagcattgattgaacaccatgatgcgctccgcatggtttaccgtgaagaaagggaaggcatcattcagacatacctccctgtcacagaatgcaaggcaagctttgaaatcgttgatctgtacggaacggacgaggatatgctgaaaagccagattcagcggcttgccgatcatcttcagggcagtcttgatctggagaacggcccgctgttaaaagcggagcaataccggacagaacaaggcgatcatctgttaatcgcggttcaccatctcgtcgtggacggggtttcatggagaattctgctggaggatttcgcttcaggttataaacaggcgcagcagcaaaacagcatcgtcctcccgcaaaaaacccactcctttaaagattgggcggaggcgctgaacacgtttgcgcaatcagaagagctgaaaaagcaggcggattattgggcgcaggcagatgcggaagagctccggccgctgccgaaagaccatgatccggacaaacggctcgtcaaacatacggcggccgtgaaatgtgaattgactgaggaagaaacggcacagctgctgacagatgttcatcatccgtacggaacggaaatcaacgacattctgctcagcgcactcggcttaacgatcggtgaatggacggaaaacggcaaagtcggcatcaacttagaaggacacggccgggaagaaatcataccgaacgtcaatatttcacggacggtcggctggtttacggcccaatatccgttgattctgcagatcagcaaggaagacggcgtctcttccgtcattaaaacggtaaaagagacagtgcggcgcgttccagataaaggtgtaggatacggaattctccggtatctgtcatccgatgaaacagaaaaaggcgccgcgcctgaaatcagttttaactacttggggcagtttgacaatgaagtgaaaacggaatggtttgagccgtctccatatgatatgggacgtcaagtcagcgaagagtcagaggcgttatacgcactgagcttcagcgggatggttacaggcggccgcttcgtcatttcctgctcatacaatcaggaagaatatgaaagaagcaccgtcgaaacacagatgcagcggtttaaagacaatcttttaatgatcatccgccattgcacggccaaagaggagaaagaatttacgccgagcgatttcagcgcgcaggatcttgagatggatgaaatgggagacatctttgacatgcttgaggagaatttaacgtgacaaaaacagttaacagaaggggggagcggagcagatgagccagttcaaaaaagatcaagttcaggacatgtattatttgtcgccgatgcaggagggaatgctgtttcatactctcctgaatcccggccaaagcttttacatcgaacaaatgacaatgaaagtaaaaggcagcttgaatatcaaatgccttgaagaaagcatgaatgtgatcatggaccggtacgatgtatttcgtaccgtgttcattcacgaaaaagtaaaaaggccggtccaagtcgtattgaaaaaacggcagtttcagatagaagaaatcgatctgacacacttaacgggcagcgagcaagcatccaaaattaatgaatacaaagaacaggataagatcaagggctttgatttgacgcgggatattccgatgcgggcagccatctttaaaaaatcggaagaaagctttgaatgggtgtggagctaccaccacatcattttggacggctggtgcttcggcatcgtcgtgcaggatctgtttaaggtatacaatgccctgcgagaacaaaagccgtacagcctgccgccggtcaaaccgtataaagactatatcaagtggcttgaaaagcaggataaacatgcatcactgcattactggcgcgggtacttagaagattttgaaggacaaacgacatttgcggagcaaagaaagaaacaagagaacggctatgagccgaaagagctgctcttctcactgccggaggcggaaacaaaagcatttaccgagcttgcaaaatcgcagcataccactttgagtacggcgctgcaggcggtttggagtgtattaatcagccgctaccagcagtccggcgatttgatcttcggcacagtcgtttccgggcgtcccgcagaaatcaaaggcgttgaacatatggtcgggctgtttatcaatgctgttccgaggcgggtgaagctgtctgaggataccacatttaacggcttgctcaagcagctgcaggagcaatcgctgcagtctgagcctcatcaatatgtgccgctctatgacatccaaagccaggccgatcagccaaagctgattgatcatattattgtgtttgaaaattatccgcttcaggatgcaaaaaatgaagagaacagtgaaaacggctttgatatggaggacgtccatgtttttgagaaatcgaattatgatctcaacctgatggcttctccaggtgatgagatgctgattaagcttgcctataacgggaatgtgtttgatgaggcgtttatcctgcgcttaaaatctcagcttctcacagcgattcagcagctcatccagaagccggatcaccctgtcaatacgatcagacttgttgatgaaaaggaaagagagcttctgcttaccggcttaaacccgccggctgagactcatcaggcgaagcctctgacggattggttcaaggaagcggtgaatgtaaatcctgatgcaccggcgcttacgtattccggccagactctttcctatcgcgaattagatgaggaagcgaaccgtcttgcgcgccgtttgcaaaagcaaggtgcgggtaaagacaccgttgtcgcgttgtacacgaagcgctcgcttgaactggtgatcggcattctcggcgtattaaaagcgggagcggcttatctgccggttgatccgaagctgccggaggaccgaatctcgtatatgctgactgacagtgcggctgcctgtctgctgacacatcaggagatgaaagaaaaagcggctcagctgccgtatacaggaacaacactcatcatcgatgatcaagcacggtttgaggaacaggcaagcgatcctgcagccgcaattgatcccgatgatccggcgtatattatgtatacgtccggcacaaccggaaagccgaagggcaatatcaccactcatgccaatatacaaggattggtcaagcatgtagactatatggcattttctgaacaagatacgttcttatctgtttcgaattacgcctttgacgcatttacttttgatttctacgcatcaatcctgaatgcggcacggctcattatcgcagatgaacatacactgcttgatacagaacggctcactgatctgatccggcaggagaatgtcaatgtcatgtttgcgacaaccgcactttttaatcttctcaccgatgcgggagaggagtggctgaaggggctccgctgtgtgttattcgggggtgagcgcgcgtctgtgcctcacgtcagaaaggcgcttgagatcatggggcctggcaagctgattaattgttacgggccgactgagggaacggtgtttgcgacagctcacgtcgtgcatgatataccggattccatttcctcattgccgatcggaaagccgatcagcaatgcaagtatttatattcttaacgggcaaaaccagcttcagccgttcggagctgtcggtgaactgtgcatcagcggaatgggtgtatcaaaagggtatctgaaccgtcacgacctgacgaagcaaacgtttatcccaaatccgttcaagccgggagaaacgctttaccgcacaggggatttagcacgctggctgccggatggaacgattgaatacgccgggcgtattgacgaccaggtcaaaatacgcggtcaccggattgaacttgaagaaatcgaaaagcagctgcaggaatacccgggtgtgaaagatgcggtcgttgttgcagaccgccatgagtccggagatgcatcaatcaacgcctatctcgtgaaccggacgccgctttcagctgaagacgtaaagaggcacttgaaaaaacagcttcctgcttacatggtgccgcaaacctttactttcttagaagagcttcctttaacgacaaacgggaaggtcaataaacggcagctgccgaaaccggatcaggctcaggcggcgaaagaatggatcgggcctcgaaacgcgacggaagaaacgattgcacacatctggtccgagattctcggcagacagcagatcgggattcatgatgatttcttcgcgctcggaggccattccttaaaagcgatgacggcagcgtcgcgcattaaaaaagagctcggtacggacatcccggtgcagctgttattcgaagcgacgacaatcgcagacattgccggttatctgcttcacggtgaagaaaaaggaatgaaagatctcaccatcatgaataaaaatcagtctgacacactgtttgcgttcccgccggttctcggttacgggctgatgtaccagccgctggcaaaacagctgtccggctatagaatctgtgcgtttgattttatcgaggaagacaaccgcatcgaacgctacacagagctgatcaatcagctccagccggaaggaccggtcaagctgttcggatactcggcaggctgcacgctcgcctttgaaacggccaaacggcttgaagccgaaggacgtaaagtggagcggctgatcatggttgattcctataaaaaacaaggcgtcagcgacttggaaggccgcaccgtagaaagcgatgtccaggcgctgatgaaggtaaaccgggataacgaagcgctgaatgacgaagccgtcaaagaaggtctcgccaaaaaaacaaacgcgttttattcttatttcgtgcataccgtcagcaccggcacggtcaatgcggatatagatctattaacgtcagaaccggactttgcgatgccgccgtggctcgcttcgtgggaggaagccacgacaggtgaataccgtgtgaaaaaaggctgcggcagtcacgcagaaatgcttcagggagaatgtctcgaaaggaatgcggcatatttgctcgaattcctaaggaaggaacatccgaagctgacagcttcacgatagaaaaggaggaagcccgccaatggtccagctctttaaatcgttcgataccacggaaaaaacgcagcttatctgttttccgttcgcaggaggctattccgcatcattccgcccgctccacacctatcttcaaggtgagtgtgagatgcttgccgcggaaccgccgggacacggaacaaatcaaatgtccgccgttgaggattttgaacagcttgtcagtttatacaagcaggagttgaatctccatcctgaccgcccgtttgtcctgttcggccacagtatgggaggcatggtcgctttcaggctggcgcaaaagcttgagcgggaggggatttacccgcaggccgtgatcatctcagccattcagccgccgcatgttgaaaggaaaaaagtgtctcatcttgatgatgaaaaatttctcgcccatattatcgagctgggcggaatgccgcaggagttagtggagaataaggaggtcatgtcatttttcctgccttctttcaggtccgactaccgcgcgcttgaaagcttccgtccgtctgattctcacatgattcaatcacccgtccatatttttaacgggcggaaagataaaaaatgtatcaaagatgcggacggatggaaaaaatgggccgacaatcccgtatttcatgagttttcggacggccacatgttcatattaagtgaaactgaaaaagtggcggaacgaatatatgagattattaacaggagcactgcaggccaattgttataggatatgacagacagcattcgctgtctgttttttgtaacaaaatctgcccgtgagttttctcatttatcaaaaattttatgttatgatttgatggaatataattttgaagggattgtcgtacatgaatgatgcagcaaaagagctgaacagaacattatctgaagaaaacccgcacgtgcttcatatgctttctgatttgggcagagagttgttttatccgaaaggggtgctgacacaatcggcggaagcgaaagccaaggccggaaagtataatgccacgatcgggattgccacctcacaaggcgagtccatgcacttttcccatattcaagagacactgtccgcctataaccccgatgatatctacgattatgctccgccgcagggaaaagagccgctcagacaggaatggctgaaaaaaatgcgtctcgaaaatccttcattagccggcaaagacatcagcacgccgatcgtgacaaacgctttaacacacgggctgagcattgccgccgacttgttcgtcaatgaaggggatgcgctgcttctgccggataaatattggggaaattacaatttcattttcggtgtccggcgcaaggcatccattgagacgtacccgctttttcagcaggatgggcgttttaatgcggcggggctgtccgagctgctgaaaaagcaggaagaaaaggcgattgtcgtgctgaatttcccgaataatccgacaggctatacgccgggggaagaggaagcgtcagaaatcgtcagtgtgatcctggaggcagcggaggccggcaaagagattgtcgtgctcgtagacgatgcgtattacaatctgttttacgatgaaacggccattcaggaatccatcttcagcaaactcgcccaagtgcacgaccgggtgctttgcgtaaaaatagacggcgcgacgaaggaaaattacgcgtggggcttccgcgtcggttttattacgtacagcacaaaaagcgaaaaagcgctgcgcgtgctcgaggaaaaaacaaaagggattatcaggggaacgatttcaagcgccccgcatccgtcccaaacgtttatgctgcgggcgatgcagtcaccggaatacgagaaagaaaaatcgctgaaatataatatcatgaaaaaacgggctgacaaagtgaaagccgttcttgcagaaaacaagcactatgaagacgtatggacgccttatccgtttaactcgggttatttcatgtgtgtccggctgaaagacataaacgccggcgaattaagagtgtcgttgcttgaaaagagaggaatcgggacgatatccattaatgaaaccgatttgcgaatcgcattttcatgtgttgaagaagaatacatcgcggatctgttcgaagaaatttatcaagaagcaaagcagctgcagaaacaggcggaaatatcaggctgacaaaaaaaggagggggataccctcctttttctatgcttacatcagctcttcatacgttttcatctcaatcccgtcacaaaaatcgggatgcgccgcacaaacggccagcttatattcctcgtccgcatcatatgtgcggatgaaacaaggttcatgtccgtccgggagctcaatggacacatggccgtcgtctttgaggcggacgctgaatgaatcaagcggaagggaaagcccttttccggcctgcttgataaagctttctttcatcgaccacaggaggtaaaaataatcggtctgctgatcggggtgtttcgcttgcagatcactgtattccgtcggcgaaaaaaaacgtttggcgatatcaatcgtgccgggcttcattttttcaatatcaatgccgatcggttttgaatcaacggcacacacgatccagcgcccggagtgggaaatgttaaagtgcatgtccggaagcgcggggatgtacggctttccgtattcctggacgctgaatgaaatcgcggccggatcaagtccgtaagccttcgccgcagcggtgcggatcagcatgtcgccgatcaaggtgcggtgagcatcctccttatggtaaaagcgccggcatttttcccgcttttcggcggacacggccgccatcatccgatcctcttcccctgcagaaagcgggcggtccatatatactccgtaaatcttcatgtccagatcctccgtctgaaaatattgtcaaaaccatcctaccatatcagacgaaagctgtccgaaaataaaaaaacaaaaccgtttcggctttgtttttaatgaacggacgttgcccgcccggagatcgcgtatgttaacagtttagaggactgcggcaaagaaaaacgcagaatcagccccgtcaaaacagccgtaataatggttccggcgccgatcggtccgcccatcacccaggctgcggcaagaatcgtcagctcaatgccgttccgcacccattgcacgttccagcccgttttttcagatatcagcatcatcagagagtcccgggggcccgcgccgagccctgctgatacgtaaataccgacgccgcagccgatcagcagcaatccgatagaaaaaaacacggccgctaaggaaaaagcgtgcgcctcaggaagcagaaacgagaagaaatcaataaacattcccatcagcaccatgtttaagatagcgccgattttcgggagcgtcctcgtgaacaggcaggttaaagccacgatgaccgcgccgaccaagatggaccattggccgacagatagcccgaaatgctgaaaaagcccataatgaaaggcatcccaagggctgatgccgagagcttttcctttaatggttaacgataccccgaaagacaaaatcaacagaccggcaaaataaaacgtccagcgcatcaagaattcccgcttcaaagaggtcccttctttcataacattcattaattgtcattgtagcataaccgcccaaaaaaagaagaagcgaaatcagtgtttcgcttcttctccggctcctacaaaggattcagtatacgatttaaaaaccgctgcgtgcgttcttctttcggcgcggaaaaaatctgggccggcggtccttgttccacaatgacgccgccgtcaatgaagatgacttcatcggccacttcctgcgcgaatttgatttcatgggtgacgacgaccatcgtccagccttcgttcgccagatccttaatcactttgagcacctcgccgaccagctccggatcaagtgctgacgtcggttcgtcaaacagcatcagctcgggctgaatcgcaagcgcgcgggcgatgccgacccgctgctgctgaccgccggaaagctggaacggatataaatccattttgtctttcagtccgactttttccagaagctctatcgcttcttttctgacttgctccttgtcgcgcttttgcacttgaacgggtccttccatgacgttttcaagcgccgtgcggtgaggaaacagatgatacgcctgaaagaccatgcctgatttgcggcggaggcggagaatatcagcctgcttcacttttttggagaaatctattgaaaaatcggagaatgccagctcgccgcgattggggatctcaagcgcgttcagacagcgcagaagcgtcgtttttcctgaaccggacggtcccagaatggcgatgactttccctttttctatctccatatctatcttttttaaaatttcattctgtccgaatgatttatttaatcctttgacggaaagcatatcgaaacctccttatttggccacataacggtcgagacgccgttcgatcacatgctgtacgattgacagcaagaagcagatgatccaataaataaaggcggcttcaatatagatgaccaagatttgatcaaggttttgcgcgccgatttcctgcgcttttctgaacagctccgcgacgagaatctgtgacgcgagagatgtatccttgatcaggctgataaatgtatttgataatggcggaatggacacgcgaaacgcctgcggcaggatcacgcggaacaatgtcttgcgataggtcatgccgatcgtataaccggcttcccattgccctttcggcacggatgaaatagatgcccggatgatttcagaagcataggcgcccacgtttaatgaaaacgcgatgactgcgcttgggaaagggtccagcgtaatattaaatgtcgggaacagataaaaaatgatgaacaattgaacgagaagaggagtgccgcgcaccgctgatacgtatacgctgaacacccatctcaatggtttcatatttgacattctggcgagcgccgtaatcagcgcgatgatcattccgaaaataaaggaaagaatggtaaggggaatcgagtaatagattcccccggaaagaatcggccagaatgactgctgcaccaaatcccacggaatggctgttgcaatcacgggttccggcatgttacttagaaacatcttcgccgaaccattttttcgctattttagaaagagtcccgtcctctttcatttcttttaacgctttgttgacgtgagtcacaagttcgccgcttccttttcggaatgcgaaatatgtctgctgcggctggcctgcttcaaacgcgattttcacgtttttattgccggacgtttttaagtagttcagtacggcaagcttatcgttgtaagtcagatcagcgcggccctgctgaatgagctgaagggattgcgccatgccttcaacgccttcaattttcgcgccggcttctttcgctaatttattgtaattgcttgttaatgactgagccgctgtttttcctttgacatcagcctctttcgcaatcgtgctgtcttttttcgtcacgacgactgcatttgacgttgtgtatttatcagaaaaatcatattggttctcacggcctgttttgccgacttggttggcgacgacgtcaaaccgtttcgcgtttaaaccggcaaacatgctgtcccattgtgtttctttaaagtcagctttcagaccgaggcgtttcgcgacttcttgaatcacttcaacatcatatccggtcagtttgtcagtctttttatcatggaaggtaaacggttcgtacgttccttctgtaccgacggtcagtacgccttttttcttgacagaagcccaaagatcgccgtcttttgacttagatccgctgtcctgtgagtttccgcaggctgcaagcattgcgatgctgaccatcatgaacaaagcgaataatgcttttttcatcttctttattccccacttttctgagtagttttattgagaaaaaatagctcccaattgtaaaggataacttttttttagtatgagtcaagtaattggttttcataagcgggaattcatcgtgttccggatcaaaataattccaaaaactgtctgacaggcttcggcaggtagctgtcttttctccagatgacggccggtgtcatgacaaacgggttgtcttcgatgataaccgttttgacatgcgagcgcatatggacgggaatcatcgtcaaaggcagaattgtggcgccgaatcctgatgatacaaggctcaagagcgtcgcggagtcatggcattcacaaacaacctggaggtcgagaccgtactgttcacaaacttggaggacttggtcatacacacctcttccattgacggtgcgcaaaaggatcagaggcaaagaggcgatgtcattcagtttaatcgtttctccgcacagtcgttttgaatgctcggacagcaccaatacacacggaatgtcttcaagctccttcgattcaatgccgtcgtttttaatcaaggtggtggtgacggcggcgtcaatctgccgggtttccagaagctccagcagtgagacgggttcatcttcccaaatgttaaaggtgagatgcggaaaccgctctttcatctgtgacactttctcaagcatgagcgctgcgcagtaaatggttgacccgacggcaagtgtcccggccacctcctccttcagctcttgtacctcgattatagcgtcctcaaacttatgaagaatctctttcgctcttttcaaaaagacgtttccttcatatgtgagggtcatttgtttctttttattgcggtcaaacagaatgacgcccaattcttcttcgagctgtttcaactgtcggctcaaaggcggctgtgccatatggagctttttggcggccgtcgtgattttctgctcttgggcaatggtgatgaaataacgcaattgccgaatatccatgagaacgctcgctcctttcttttatacctttaaggtatgatacatagatttaacgaatatttttcatatggatatatcaggagtatgatggatttgacaccacatttcaagcgtaaaggagggtcaatatgaagctcgtcatcggaatgaccggggcaacgggagccatattcgggatcaggcttttagaatatttaaaagccgcggagatcgaaacccatcttgtcgtgtctccttgggcaaatgtcaccattacacatgaaaccgattatacgttaaaagatgtcgagaaactcgcatcctatacgtattctcacaaagaccaggcagcggcgatttcaagcggttcgtttgaaacggacgggatgatcatcgctccgtgcagcatgaaatcactggcaagcatccgcaccggaatggctgacaatctgctgacaagggcggctgacgtcatcctgaaggagcggaaaaaacttgtgctgctgacaagagaaacgccgctcagccaaatccatttagaaaatatgctagcgcttacaaaaatgggttccgtcattcttccgccgatgccggcattctataacaagccggctgacatggatgaattgatagaccatattgtgttccggacgctcgatcagttcggcatccgtctgccggaagcgaaacggtggtacggaattgaaaaacaaaaaggaggaatctgataatggcctatcaggattttagggaatttctcgccgctcttgaaaaagaagggcagctcttaaccgtcaacgaagaggtaaaaccggagccggacctgggcgccgccgcgcgtgcagccagcaatctcggggataaaacccctgcgcttttgtttaacaatatttacggacatcacgatgcgcaggtggctctgaatgtcatcggctcgtggccgaatcacgcgatgatgctcggcatgccgaaagatacgcctgttaaagaacaattctttgagtttgccaaacggtacgatgcatttccggtgccggtcaaacgggaagaaaccgcgccgtttcatgaaaatgaaataacggaagatatcaatctatttgacatccttccgctattcagaatcaaccagggggacggcggctactatttggataaagcgtgcgtcatttcccgcgatcttgaagatccggacaatttcggcaagcagaatgtcggcatttacagaatgcaggtaaaggggaaagaccgcctcggcattcagcccgtgcctcagcatgatattgcgattcatcttcgccaagctgaagaacgcggcgtgaatcttcccgttacgatcgcgctcggctgtgagccggtgattacgacggctgcatcaactccgctgttatacgatcaatccgagtatgaaatggccggcgcgattcaaggggagccctacagaatcgttaaatctaaattgtctgatttagacatcccttggggtgctgaagtcgttctggaaggagagatccttgcgggagaacgggaatacgaaggacctttcggtgagttcacgggccattattcaggcggccgcagcatgccggtgatcaaaatcaaacgggtatatcatagaaacaatccgatttttgaacatttatacttaggcatgccgtggacggagtgcgattatatgatcggcattaatacgtgcgtgccgctttaccagcagctgaaggaagcctatccgaacgaaatcgtcgccgtgaatgcgatgtatacgcacgggctgatcgccattatctccacgaaaacgcgctacggcggatttgccaaggccgtcggcatgcgcgccctgacgacgccgcacggactcggctactgcaaaatggtcattgtcgtggatgaggatgtcgatccgtttaacctgccgcaagtcatgtgggcgctctcaacgaaaatgcatccgaaacacgatgcagtcatcattcctgatctgtccgtccttccgcttgacccggggtctgatccggcagggatgacacacaaaatgattcttgacgccacgacgcctgtcgcgccggaaacaagaggccattattcgcagccgcttgattccccgctgacaacgaaagagtgggaacaaaaactgatggacttaatgaatcaataagaaaggatgagtttactatgaaaacatgcccgcgatgtgaatcgcaaaaaggagaaaccgtcagccaatcgccggtcaaaggcgcttgggaaatataccaatgccaaacctgctttttcacatggagatcctgtgaaccggaaagtatcacgaatccggcggcattcaacccggcatttaaaatcgatccgaaagaaacagagacggccacacatgttcccgctgtcccggaaagaaaagcgtaatgctgacggagcacttgccggaggcgctttacgcgcttttagacggaacggaacttgaaaaaaagcagcacgacgcatttgtgctccaatccgtgacaaaagaaggccgtccgcacgcggccatgatcagcgccggtgaaatcgcggccgtgagcagaacaaatctccggctcgccttatggaaaaacacgacgaccgtaaaaagcctgctgcattcgggacaagctcttttcatcgcctggcacggaggagccgcatattacgtcacattggaatgtaaggcgcttccgccgttgaaagaggcgaaacacgagcgggaacggttcagctgccgcgtgatcaccgtcaaggaagatcgggcgaaatacgcggatctgacatcaggaccggccatccagctccacgaaccggaagatgtcctgaagagatggagagaaacacttgaggagttaaaacgatagacgcacaaaaaaagcctgcggacgattccgcaggcttctcttttattgtacgcctttcatcgcccgtttaatgacgggagacagaagaattaaaataataccgagaatgatcgaaacaagaccgattgagccgaagtaggccgcttcagaaatcttatcaaacaaaccgactacttttgcgttcagggcttgaccgcaggcgtttgttaaaaaccacatactcatcgtctgcgctgagaaagctgcaggcgcaagtttcgttgtgacggataaaccgaccggtgaaaggcaaagctcaccaagcacaaccaaaaggaagctgagcacaagccaaagcgggctcacaagctcgccgcttccgcccataaccggaagcaccatgactaaaaatgataatccggcaaggataatgccgatcgcgaatttaatcggtgttgaaggctggcgtttgccgagcttcatccagatccacgcgaacaccggcgcgaaaataacgatgaataatgggttcagagactggaaccatgaagactcaagatgcatgcccgcaaaggaaagtctcgtgcgctgatccgcatataaagctagaatcgtcgcgccctgctcctgaatcgcccagaacattgccgctgcaataaacagcggaacataagccgcaagccgtgatttttccgttttcgtcgcttttttgcttgtgaacatcacgataaagtaaataaccggaatgacaatgccgaggatactgacggtgtcaatcacacgctggatcgtcagccagccggtttgaatcagaacaataataacggctgctgcgatgaccactccgattcccgtgccgatcactgatgatttagaaatcggattcggtacattggagcctgctttgccgaggtatttctttctcgttagagcgaaaacaatcagtccgaggaacataccggccgcggcgcatccgaagcctaagtggtagttgtacttctgtccgagtgttccgacaattagcggcgcaagcaatccgccgaggttgatccccatgtaaaagatgctgaaacctgagtcgcggcgctcgtcttccttcgtatataaatctccgacaacgctggatacgtttggtttaagcaggccggttccgataatgatcagagccatgctggtaaaaaacgccgccgtgctgccggggaaggcaagagcgatgtgcccgaacataattaaaattccgccgtaaaatacggtgtttgccgtgccgaatacccggtcggccagccatccgccgatgacgctcgacatatatacgagagatccgtatatggacatgatggcaactgcggtcgttttatcaaagccgagaccgccatgagcgacttccgtgtataaatagtaaagcaatatggctctcataccatagtaggagaaacgctcccaaaattcggtaaaaaacagtgtgaacaagccgcggggatgaccgaaaaagcctcgttgcggcacagtttctgttatagattccttatcaatagatgccacctgagccaaccctttcttaaaaaagtgtattacaaaaatcatattcttatataatacttgtgtcaatataatttatactgaattcaaaaaattccagaatgaaaagatattaaaacggtgaatatagacgaattttcctgattccaatgacttattttgttatattatctgactaaactatctttataaacttttttaataaaatttaaagtatgtacaggcggagcgggatatggcggaataagatgacaataagagaggaaggaggagattatcacttgccgaatcgtatattggatattacggattgcggtgtggcggcagacggaaaaaccgatgtgacgggcgccatcaaccaatgcttggccagagccgtcagcgaaggctgtcatacggtgttttttccgcccggaacgtataaaatcaacggcacgcttggcggggacaaaagccagccgtttcggaacgccgggattaacgtgccgagccatctcaccatcgttttagatccggaatgcacgattaaagtggcgccgaacagctcctggggctactcggctttctatataggcaggcgtgaaaatgtcaccatcaccggcggccggatcatcggggaacgggatgaacacacgtataccaatgtccctttgcggtcgacccatgaatgggggtttggaatctgtattgaaggcagcagcaatgtgctgatcgaaaatgtgaagatttcagattttacgggagacggtataattgtcagcccgctcgggttaaaaacaaacagtgattacgaaacttcagaacaggtgaccatccgccgctgtgagatcaggcagtcaaggcggaacaacatttcaatcaccggctgcaataccgttacggtggaagaatgcgtgattgaagacgccgggcaagggaacggaacggctccgaaattcggaatcgatattgaatcgtacggagaaggcgatattgattatgaagaagctcttcatattacggtccgcaacaacttcttttccggaaacgccgcaagctcagtcaccaattttaacggatataatgtgttaattgaaggaaatcattccgataacacaatcagctacgggtatggggcgcataccgtcattacggggaatgtcttctttcggtcagacggcggctcaaggaccgcagtcgccggacaaggtgtgtcacaaggacaggacagcagcagtgccgtcatttccaacaatctgattaccgggttttccaccggaatagatgtaaggggaaaaagcgtcctcgtcacccacaacaaaattaatcaatttgaaaatacgggcatttccgtctatcaggcagaagatgtgaccgttgacggcaatgtcattgaaaacggacgttccgaaacgagacgaagcacggggatgcgggcgacgctttcggagaacgccgtctttacgaataacactctgaatcaggtgacagacggaatcagcatgtcggccggcagtatcattgtaaaacaaaatgtgctgaaatcgttcagccggggcatatgggtcacaggcggaaatgccgttattgaaggaaatacgctccttccgaatgcgtatcagggcgccgcggagtcctatgccgtatctgtgacaaatgacgccggggctgtcatcaaaggcaatctctttaagaactataaaaactatcccgtattcagttcaacatcctcgggaacctctgtcatcagcaaccgctttgaatcatcaccgcttatcgttaccgtgtatctgaactcaggcacgcatgaagtcatagacaatacgctcacgatcaaccgaacagcgggcagcccgatcggcatctatctgaacggagcctccaattccctcgtttcgggcaataccatcaacaacctatccgccgcttctgcttccgccatccaaaccagctcctccgcaagtactaaaatcatcggcaaccgcattatcaaaggcgtcattgtgaagcacgcgacagatacggaaagcggaaatatcgtcatctgagaacaatctgcgccggaaaaataaaaagaacacatgaactccgagagaaggaggaatgtgttcttttttgacacaatacagccttgcgcctgtcaggcatcttttttacctgatttatataaagcgatcatttctctgattaaaaagagggcgaataaaaacagcatcagccattctgagaaggtggtcaatttaaaagcggacaggttgttttgaaccgctccatagaaactgaaaccttgcagcatatccaccgttactgaaatgatcagacaggcagtcagcaaaaagaatgaaacccctaatattttcatgcgcatcactctccctttttatccttttcgattacgcagaacttatacagactttccgccgtgcataatcttttgccgtacaggaagaatatgaaaaaaacgaggaaaggttttttgcgatatgccgccattttttaagcagaggaaacaaaaaaaagccgatcaaaacgaccgtgacaatgaaggcagaaaagaagcggacagccagccggacaaagagcgggatgagccgatctccctcagcttaaagcaaaatatgaagaagctgtctgagaggttcggcaacagtgccgatgtcgtcatccgccggctgaaaatcggaaaagaagagcttccggccgcaatcgtgtatatcgccggtttggtagacgaacagcttgtcagccaatcccttctggaggatttaatcgatatcccgtccgttcagccggaacaagcggtctgcctgatatacgataaaacgcttgcgatcggcggggtgaaagaggaagaaaaatggaaaagcctttatgccgggctggtggcgggcagcacgctcatttttgtcgacggggctgacaaggcgctgatcgccagcacggaagggggagagcaccggtccattcaagagccgagcactcaggtctctttccgcggcccgcgccagggattcactgaatctctgcaaaccaatatttccatgatccgcaggtatgtaaaaacgcctgatgtatgggttgaaaaaatggagatcggacacgaaacgaatacggatgtcgcgctgatgtatattaacggaatttgcgataaaaagctgattaaggaagtccgcaagcggctgaagcacattgacatcgacagcatcctggaatccggctacattgaacagctcattgaagacgcgccgttttctgtgttccccaccgtatatcatacggagcggccggacgtcgtggcggggaatctgctggaaggacgatttgcgattatcgtggacggaacgccgttcgttctcatcgcgccggccttatttattcaattttttcaatccgttgaggattattattcacgatttgatatcgccacaagcatcagggtgctgcgggttttgattttcttcatttcactggtggcgccggggatttatgtggcggcgacgacctttcaccaggaaatgattccgacgcagctgctgattgtcatcgcggctcagcgggagacggtgccgttcccggccgtgattgaagcgctgacgatggaagtggcttttgagattctcagggaggcgggtgtccggcttccgagagttgtcggctccgccgtttccatagtcggagcgcttgtcatcggccaggccgccgtacaggccggcatcgtctccccggccatggttatcgtcgtcgcgctgacggcgattgccagctttgcgaccccggcttttgacatggcgatatccgcgcggctgatccggtttctctttattctgtcagcggcggtcatgggattttacgggctgattctgggcattatcatgatgttcgtccatctgtgcggcctgcgttcattcggttttccgtatatgtccccgctcgctcctttgaccccgggcgggctgaaggattccatcctccgcgctccgttatgggcagatgaaaaaaggccggaactgctcgtgcaggaaaacaacaggcgccaaggggaacatcaaagaccgaaaccggagacatccagagggatggttaataaagatgtagaagagggcgacggtaatgaaaagacgtaaatggatacttatcctttgtacgatggtttcccttatgtttgtatccggatgctgggataaaagggagctgactgatttggctgtgatctccgccatcggtattgaccggaccgaaacgggaaaatacgtccttcacttgcaaattatcaatccgggaaacgtggccggcggtctgcagggcggcggagcgggagaccggcctccggtttccgtctattcggtgtccggagacaatatgacggaagctttgagaaaaggctcgatgaaagtgtccagaaggctctattttgcgcatacgaatctcgtggtgttcagtgaaaagctggcgaaagaggaagggctcagttttattctggacaatcttgaccgcgacaccgaattcaggacgaccgcaaccgcggtgatcgcgcataattgcaaggctgaagacattattaaagtgctgacgccgattgataaaatcccttccaataaagtgaacaagacgctcagcttcacgcaggaacaatacggcagagtcattaaaaccagccttcaggacgttctgattgatctcgcttctccggccgggtcgccgtttattccgggttatgaaatgcacggagacgataaagccggtcctacgatggaaaatacgcagacgactgaaccgaaagcagtgctgtcagcggacggactggcggtgttcaaaaaggatgggaggctggattactggattgaggatgacgacagtgtgggggctgtatggctgctcaataggatcaagcatacgttcatcaatgcggattggaagaatgtgaagcacgcaatcagtctgcaggtcacccgccagaatacaaaggtgacggccacttttccgaacggaaaaccgcatattcacgtgcatgctcaggtcgaggggctggtggacgctgtcagataccctttccatctgtctgatccgcaagtgctgatgacgatgcaaaaggcgctcagcgtgcagcttgacaaagatatcaccaaatcaattgaagatataaaagcccgtaagaatgacttcgtcggcttcggagacctgatctatcggaagcatccggacaaatggaaaaagttcaaagggaagtgggatgaagaatatttccccaatctccccgtagatgtcaaaacggaagtcattatcagaagaacgggcttgcggaataatcctctctcagacaagcttgagcatgattgatttgaggagaaaggagcgaagcgtatggaaaatgcgaaaatcggcacgcgtcagctgtttattatgatcattttgtttgaattgggcagttcgttattgatcccgccaggcacgatggccgggcgggatgcatggctgtccgtgcttctcgggtgcgttatcggtctcggacttttctacgtttatcaggcgctgtatcaattttttcctgagtcttctccgagagattacatgaacgaactgatcggcagacatctgagctgggcggtctcgcttctttatattctctatttttcttatatcgcggcccgcgtattgcgggattttggcgaaatgcttgtcaccttcgcctaccaggacacgccgcttttaattgtgaatgccatgctgatgatcgccgcgatatttgcggtcagaaagggtattgaagtgatagcgagagccggcgagctgctgtttggcattatgtattttctgacagccgtcgggctgatcctcattatcagctcaggcacgataaacctcagatttctccagcccgttttagcggagggtgcaggaacggtcatttattccgtgtttaaacagacgatgttcatcccgttcggtgaattaatcgtgtttgtcatgattttcccttatttaaaagatcggaaaaaggtgaagaaaaccggatttctggcgattatcatcagcgggctgtttttggcgatgtcagtggcgattaatatttgtgtgctggacgtcaacttaatgctccgctctcaatttccgctgctgagcaccatacagacgattaaagtagaagagtttttagaccggctggatgtctttttcatgctcgtgctcgtcatcggcggttttttcaaagtcagcctttttacatatgcggttgtcgtgggtgtgtccacgctgtttaaagaaaaaaatccgtctcagctggcctttccggtcggattgggggtgctgattctctccatcagcatcgcaagcaatttttcggaacacatgaatgaaggcttaaacattgtgccgatctatattcatcttccgtttcaagtgctgtttcccgttttgctgcttatcattgccgttattaagaaaaaggtcaaagggaccgtctatacagtttcgaagaaataacccggacggtgcgccgggttatttttaaaatcatgatttttgtcttaatgcattgacaaacttgcgtgacaattgtacattttgatttattcttataaaattactaggaaatataggtttagtggtgttaatattttccgaaccgtatttcagaatagaaggagatccatcatgacaaagaaaaaagaaatcaaactcggtgtgtttctcgcgggcaccggccatcatgtcgcttcttggagacatcctcaggcaccggcggacgcgagcatgaatttggattatttcaaagaactggcgaaaacggctgagcgggggaaattggacatgctgtttttggcggacagtttatcaatagacggcaaatcacatccgaatgtgctgacgcgctttgagccgtttacgctgctgtcggcgctcgctcaggtcacatcccgcatcggtctgacggcgaccgcgtctaccacatacagcgaaccgttccatatcgcgagacaatttgcatcgcttgatcatctttccaacggccgagcgggctggaatgtcgtcacatcttcgattgaatcgaccgcgcttaatttcagcggcgaaaagcatcttgagcaccatctcagatatcagcgcgcggaagaattcgttgaagtcgtcaaaggattatgggattcgtgggaggaagacgcctttatccgtgacaaagagtcaggagcatttttcgataaagaaaaaatgcatgaattgaaccataaaggaacatatttctccgtgagagggccgttaaatgtcgcccgcacacctcaagggcgcccggtcattattcaggccggatcatcaggagacggaaaagcgctggccgccaaaacggcggaggtcattttcaccgcgcaaaatcatttggagtccgcgcaggaattctatcaatctattaaagaacaagcggcttctttcggccgtgatcctgaaaaaatcgcgatcatgccggggatatttcccgttatcgccgataccgaggaagaagcgcaggcaaaatatgaagagctccaagatctcatcattccgtctgtcggcctgaacattctgcaaaactatctgggcggcgtcgacctttccgcctgcccgcttgacggcccgctgcctgaattggatgcggatgcgtcgaatgccgttaaaagccggttcaagctcgttcaggagatggccaaacgcgataacatgaccatccgcgagctgtacaaatatgtggcgggttcaagaggccatcatatctttgtcggaacgcctgaacagcttgccgataagatggaagaatgggtcggaaaacaagcttgtgacggcttcaacatcatgccgccgcttttgcctgaaggtctcactctttttgtagacaaagtgattccgattttgcaagaacggggcgtgttcagaaaagagtatgaaggaaccacactcagagaacatttcggactggaaaaaccggcaaaccgatatgccgactaaaggagggctcatcatgtcaagacaataccggctcgcaacggaggcagacgctgatgagctgctttcactgacactgcgggcgtatgaaccgatccgcaagctcggcatcaactttgccgcagcaacggcggataaggagctcgttttgaataacatacaaaaaaacgcctgttacgttttggaggaagacggacggattctggcgacgatttctctgcggatgccgtgggggccgaatcccgggccgtacggtgtccctcatatttggtggttcgccgtcgatcctgaaaccggaaaaaaagggacgggctcagacatgctggagtggctggagaacacagtgctccgcgatacattaaaagcgcctttcgtgtcactgggcacagcggacaagcatccgtggctgatcggcatgtacgagcggaaaggctacgtccgcgcaggcgaaaaggatttaggaaaaggccacatcaccatctatttaaaaaaacaattgcaggattaacattttaataggaaaaggcgggatttcaatgaagaagaaaacatgggctttgctgctgtctgccgcgcttttggcggtcttaacagcatgcggaaacggaaaagaaagcgaaggcggcgataacgtgctgcatgtcggcgctacgggacaaagctatccgttcgcatataaagaaaacggcaagctgacaggctttgacgtggatgtaatggaagccgtagcgaaaaaaatcaacatgaaactggactggaagctgcttgagttcagcggactgatgggcgagctccagaccggcaaactcgacaccatttcaaaccaggtcgctgtcacggacgaacgcaagaaaacgtataacttcacagaaccgtattcgtatgcgggcactcaagtcgtcgtcaaaaacgataacaaagacatcaaatcagtcaatgatctgaaaggaaaaacagtggcggccgttctgggctcaaaccacgcgaaaaaccttgagagcaaggacccggataaaaaaatcaacataaaaacatatgaaacacaagaaggtacgctgaaagacgtggcttacggacgggttgacgcctatgtaaacagccgcagcgtcctgatcgcccagatcaaaaagaccggtctgcctctgaaattagcaggagacccgattgtctatgaaaaagtcgctttcccgtttgcgaaagatgcggctcacgataaaatccgcaaaaaagtaaacaaagccattgaagacctgcggaaagacggcacgctgaaaaagctgtctgaaaagtactttaacgaagatatcacaaaggaagcaaagcaataagaaacggcggtgaaaatcgagaatgaacagcattgattggggatttatgttttcagcttttcccgcgttaatcgaagccttgccgatcacattactaatggccgtcgcggccatggtatttgccgtgatcggcggccttatattagcgcttatcacaaaaaatcgtattcctgtgcttcaccagctgtcaaaggtgtatatttcatttttccggggcgtgccgacgctcgtgcagcttttcttaatttattacggcctgcctcagctctttcccgggatgagcaagatgacggcgttaactgcggcgattatcgggttaagcctgaaaaatgccgcctacctggctgaaatcttccgcgctgcgctcaactcagtcgatgaggggcagcttgaagcctgtctgtctgtcggaatgacaaaatcccaggcgtacagacggatcattttcccgcaagccgtcagaaacgcgcttcccgcgacgggaaatacgtttatcggcctgttaaaagaaacatcgctcgcttttacattaggtgtgatggagatgttcgcccaaggaaaaatgtacgcatcgggcaacctcaaatattttgagacgtatttagccgtcgcggtcatgtactggattcttacgattatttacagtgtgctgcaggatctgctcgaacgggcgatcagcaagccttatcgcacataggaggaggctcaggatgatacaagtcagacatattcgaaaagcatttaaagatcttaccgtacttgacgggatcgatcttgagatcaaaagcggcgaagtcacggccatcatcggcccgtcaggctcgggaaaatcaacgctcctccgctgtctgaatctgctggagcgcccggatgacggcatcattgaaatcggcgatgcaaagctgaatgcagcgtcctattcgcgcaaagacgtacacaagcttcgccagcagacggcgatggtgtttcagaattacaacctgttcaaaaacaaaaccgccctgcaaaatgtgacagaggcgctgatcaccgcgcaaaagaaaccgaaaaaagaagcggaacagatcggtatggacctgctgcggcaagtcggtttagaacacaaagcggacagctacccgattacgatgtcaggcgggcagcagcagcggatcgggattgcgagagccttggccgttgatcctcacgcgattttactggatgaaccgacttcagcccttgaccctgagcttgtagcaggggtgctccaagtcatcaaatcaattgccgaaaaacagacaaccatgatcatcgtcacgcatgagatggcttttgcgcgtgaagtagccgacaaagttatttttatggcggacggacgcatcatcgaacagggaacaccggaggagctgtttgacaatccgcagaacgaacggacgaaaaaattcattaagcaagtgggagagcctgccgaacttgtctaagaagggaagaagaagaaatggcaaatgaaacgtatgaatcattaaacaaacgtttaatcaatatccgccgcgaccttcatgaacaccctgagctgtcaggcgaggaattcgaaacgacgaataaaatccgccgctggctggaggaagaaggaatcacggttcttgatgtgccgaaacttcaaaccggagtgatcgctgaaatcaaaggagataaaagcggccccgtcatcgccgtcagagcggacatcgacgcactgccgatcgaagagaaaacaaaccttccgtttgcttcgcgcaacagcggcgtgatgcacgcatgcggccatgatttccatacggcatctatcctcggcacggctttcttattaaatgagagaaagcatgagctgaaaggaacggtgcggtttatttttcagcccgcggaagaaatcgccgccggagcaagacaggtcattgaagccggcgcgcttgacggtgtatcggcgatattcggcatgcataacaaacctgacctccccgtcggcacggtcggtctgaaagaaggcccgcttatggcgagtgtcgaccgctttgaaatcaccgtgaaaggaaaaggcggccacgccggaatccccgacaacagcattgacccgattcaggcgacagggcagatcatcggcggcctgcaatcgattgtcagcagaaacatcagctcgcttcacaatgccgtcgtcagcatcacaagagttcagggggcagttcttggaatgtcattccggaccatgttgaaatggaaggaaccgtccggacgtttcaaaaagaagcgcgggacgctgttccgaaacatatgaagcgggttgccgaaggaatcgcggccggattcggggcagaggctgacttccgctggtttccttacctgccgtcagtgatgaacgatgcccgattcatacaggcggcggaacaaacggctgaaagcctcggacttcaaaccgttcgggcagaacagtcgcccggcggcgaagacttcgcattatatcaagaaaaaatccccggcttcttcgtctggatgggaacaaacggaacagaagaatggcaccatccagcctttacactcgacgaaaaagcgcttccgaaagcggctgagtttttcgcccggcttgccgtcaatgtattggagcagacggaatgaatacggaaaatctgacggccggacttgctcaggccgtcatgtcgtctgtgccggaaacatccgccgaagcgatgaaagaagcgcgcaaaggactgcttgattttacagcggctgcttttgcggggagacgggatacaggagttgaaaagctggtaaaactggccgaagaagaaggcgggatgccgatagcgccgcttatcggcagaaatcaaaaaaccacgccgtcccaatccgcgctcattaacggcttcatcgcacatgcgcttgattttgacgatgttcattctgatgtaagaggacatccgagcgcggtcatcctcccggctttgattgcagccgcatcagccggccggatagacaagagccgttttctcggtgcttatgtgacgggaatcgaagtgatggcgcggctcggcgagtcagctggaagggatcattacgagaaaggctggcacaatacaggaacgttaggtgccatttcggccgcatgcgccgtcggattcgcagagaatctgaatcaaacccaattacagaaagcaatcgggtttgcggctgcccgttccggaggcatgagagtgcaattcgggacagaaatgaagccgctccacgccggcctggccgctcaagccggggtgttcgccgtaaagcttgcaaaggccggtttcggcggctcagctcatgcgctcgacggggagaaaggttttttcggactgtacggcgatcttgaacgggcagaaaccctgcttgtaaacgggtggggaaacccttggcggatcgtgagtccgggactttggtttaaggtttatccgttttgctcggcggcccatcatgcggcggacgccattctcaagctgaaggccgaacatggtctcactttcggccaaacggaacggattgacgtgatttatccgccgggcggggacgccgcattgacagaacggcgtccgaaaacaggcgaagcgggtcggttcagcgtagaatatgtgatcaccttagctttgcacggtaaggatttttcagttgaacatttcacatccgagccgattccgcaatcccttcaaaaaggatttgagcggattcaccgcagctgcgatgaccaaattcagccggctgacaacgccgttccgaagggccgttttacaattgtacgggtcacggtttccggcggtcatgtctatgaagcacgtatcgactgtccgaggggagcgccgggaaacggtctttctgaaaaagacattgaagacaagctccggctcgctttgccgggagaagagaaaaaggcggaagaattgatcaaagcagccggacaatcaaatattgaccgttatttacagctgatataaataaaaagagcgaggggatgcagccctggctctttttacgttcacttctattgaatagggggatatagggtgcgcccctgtctgcgctggcaggggcgcggtatcaggaaacggccgtgccgttttctttgaccgtgaaacttcctcttgataagcggatgttgatatcagacactttggcaatttgttcgtcgtgcgtaaccatgatgacgcatttgccgtctttatgcgccagatcctgaaagagccggacgatttcctttgacgtatcctcgtcgaggtttcccgtcggctcatccgcgcaaatcagatccgtgtcacagcagaaagcccgcgcaattgaaacgcgctgctgctgtccgccgcttaatgtcagcacccgctgacgggcctgctgttcggtgatgccgactttatccagcatgctgagcgcggacgcatctttgttgttctccttagatccggtaatctccatcgcggttgtgacgttctggagcgccgtcatatacgggatcagatgatgagattgaaagacgatagagacatattgatttctgaatttggttaatccgattttgaagatgtcttctccgttataaaggatgcttccctctttaggtgtgtcaaggccgcccgccagagacagaaacgtggtttttcccgttccggaggcgccggcaattgtataaaacttccctttttcaaagctgatcgttatatcctgaaacagcggctgtgatttatcttggtaccagtagccgatctgttgaaaggttaataggctcattatgctgcctcctcttattcctgcttggtcaggatcgttttagggtgaagccgcatgactgatacagacggcagtaatgtggcgatgacggcaattgcgacgccgatcccgccgagaatcagaaggtcattcagcgaaacgtttacctgcattgtactgatgacatctgcaccggatgaatgctgaccgaacatgccgtctccccgcggcatttctcctccgccccagccgcttgtttgctgctgggaatcatcggctgagctgacctgctgggaaagaagctgatttccgagctgattcgccacaaggctgcccgtgacggatgcgatcccgatggcgataaccgcgacaatcagaatttccgttaagaattgtccgatgagcttccagcgcttttcgccgatcgccatcaagacacccatttcatacttgcgttccctgatcgacatcatcacgatcaatccgagaatgaccgcgcccgcgatggatacaaggtacaccacgtttttagaaaatgacgcgacattttcaatcgggccggccatttgctgatacacctgatcatttgtcgtcagcgtgtaggttttatcatctatagatgtttttttcgcagccgcaacgaatgagtcaatatattttgcatcatccatataataaacggctgagctgattctgtttttgttatcagacccttttaacgccgcagctgcggtgtaaggcgtatagattttattgtcagggtttaagaatgaaaaatgctctgcctgatcgtctcctgatgatgttgttttataaattcccacaattttaagctttgtactcacagaatcatccgctgctgaggaaactgtaatggagccgccgaccttcagcttgttttgatctgccagcgtttcattgatcactgcgacttttgcgtccgcatctgtttttgtgatggcgcggccatcagtgatttttgagctcccgcctgtgaaatcatcaagcagcgccgtagagagcacgccttcgaccgaaatatccgctgaaatcatctgtcttccgccgccttgaaaacggcttccgccggaactgttatcggctgattcgtctgagctttttatcgcgtcaaagctttctgcgtttgctgacgctgtcgtgaggaagttgtaatttttaacgtgctgtaaagatgtaagtttcttggcatccgagacggaaatcggcgttgattcaaacgtcctcttttcaccgtctttttgctgctgcgccatttgcttttggcggtcagcctggagtgtgacgctcccgccgagctgctgccttgccagttcgcttgatttctttgccgctgactggatcgtaagaccggacaggacaaaaatgcaaatcactgaaaacacaaccagctgcaaaaacgtttttcccttttttgccttcatgctccaaaaggctctttttataaagttcatgtctgttcctccgtgtgggtgtcagatcttgtaaaaccagccttctttagaaccggttatccgatatgtatatagtaggagaaatgtatgaaaaaaatatgaacaaactatttccgggtgatgaaataaaaactaacaattgtgaaacgcgaaaatatccgggtaaaatggtgctattataagtaaaagcgtcaagataaacggaggacccaatgaagatattaatgatagaagacaatataagcgtatgcaccatgacggaaatgttcttttttaaagaaggatttgaagccgaatttgtccatgacggagtggaaggctatcagcggttcacggaagaggactgggatttggtcattctggatattatgcttccatctatggacggagtgacgatctgccggaaaataagagagacgagcagtgtgccgattattatgctgaccgcaaaggacacggagtctgatcaggtgatcgggtttgaaatgggagccgacgactatgtcaccaagccgttcagcccgctgacgctagtagcgcggattaaagcggtgatcagaagataccgggcgacggggcaggccgtaaaaagcggcgacttgatcgaaacggcgtgtttttcaatcaataagaagacgcgggaagtgtttctgcatggaaagcctgtcgagaatctgacgccgaaggaattcgatctgctcttttatctcgcacaaaatccgcgccaggtcttttcgagagagcagctgcttgagcaggtgtggggctatcaattttacggcgatgaacgtacggttgatgttcatattaaacggctgcgcaaaaaactgtccagtgaggaaaaaccgtttttatacacggtgtggggggtaggatacaaatttgatgaggattaaatacttatatcagctgctgttaagccatgtcagcattttgattttggcctttttcattatcatttccctgttttcgcactttgtgaaagattttgcgtatcaaaataaagtggatgagctgtcttcttacgcccagcagatcacaagtgagctgaacggacgcgatcttgatctgcgccgcctgtatccgtatcaggacatgttaaaaacgcgcgagaccaggtttattatttttgatgaacatcagcggccttacttttttcctgacgatatgccgccgcgcgagaagctcaaaagtaaagagtggcacatgctgaagcaagggaaaaccgttcagatcagagcggagatgaaccgttttaatacggagggcttggaagtatcgcttgtcgcaaaaccgcttttgatcaacgatcaatttaaaggcgcggtgctgctcgtgtctcccgtcagaggggtcgagcagatgatcagccaggtcaaccgctatatgatttacgcgattatcagcacccttatcatcacgattctgctgagctggcttttatctaaatttcacgttaagcggattcagacattgcgggatgcgaccggaaaagtggcatccggggattacgatatttcgctcaagaacagcggcggcgatgaaatcggcatgctggcgtccgatttcaacatcatggccaaaaatctgaagcaatcgagagagcagattgaccgcctggaaaaacggaggcgccaatttatcgccgatgtctcccatgagctgagaacgcctttgacgaccattaacggacttgtggaggggcttaacagcaacaccatcccggaaaaagataaagagaaatgcttctcgctgatcagtgaagaaacgaagcggatgctcaggctcgtgaaagaaaatctggattatgaaaaaatcagatcccagcaaatcaaactggacaagctcagtctgccgctcatcgaggtgtttgaaattattaaagagcatctcaatcagcaggcggaggaaaaacaaaatcagctgcggattcaggcggaggacggcgtcaaagtgttcgccgattatgacaggctgatccagattctcgtcaacatcacgaaaaacagcattcaatttacgcaaaacggagacatcacgctgcgcgggtatgaaggctataaagaaacggtgattgagatcgaagacaccggaatcggcatctccaaagaggaaattgagcatatatgggagcggttttataaggcggacgtgtcccggacgaatacggcatacggcgaatacggactcggcctgtccatcgtcaggcagctcgttgaaatgcacaagggcacgatagatattgccagcgaaaaaggaaaaggcacgacgtttacaatccgccttccgctgaatacgatacatgaatcatcttgaaaccggcagtcccgtctggctaccggctgttttatcttcactcggaaaattgcgctctgccgaaacaaagtttgcgtgtttttcgggatggaaagacacggaaacgtgataaaataactggtaaacaggtcttggatggggagggtgaaggaatgaagagcgggttaattccttcttcagcagtcgggcagaaaattaacgagtggtatcgatacatcagaacattcagcgtgccggatgcggagatcttgaaggccgagatcaaacaagagcttgaccgtatggagcctgattcaaacttagtgctttattattccctcatggaatttcgccatcagctgatgctggactacttggagccgctggaaaaactgaagatagaagaccagccgaccctgtcggaaattcttgataacattgataacagccaggccggcctcaaagggcttctcgattattacgtcaactttttcaaaggcatgtttgaatttgataaaagagaatttatctcagcgattacgtattataaacaagctgagaaaaaactggccttcgtatcggaccacgtggaacgggcggagttttattttaaagtggccgaagcttattatcatatgaaacaaacgtatttttctttgatacatataaaaaacgcttatgaaatttacgtagagcaggacacatataacgtcaggatcattcaatgccattttgtattcggcgtcaatttaatggatgaaaggcgctttgaacaggcggccaaacattttcagcacgctttgcaaatggccgaaaaagaacaaaaagcgcagcttgtcgggagggcgctgtataacctcggactgtgctactacaatcaggaccgcatcggcgaagcgattccgtactttgaacgggcggttgatacatttgaatcacaaagaatcgtcaattctcttcctcaagcatatttcctaatcacactcatttactttaaactcggaaaaaaagaaaaagcgtcggaatatcacaagcggggatatgaatatgctaaagaaacagacgatcccgtttacacggtaaaattcgaatggctgcaggctctgtatcaggcgaaaccggatgaggaaacaatcagcgcgtgtttccgttacctggaagataaaaatttatacgccgatatagaggatttagcactagaagcagctaaatattactatgaacaaaattgctttaagatttcttctgactattttctgaaagtcgaagaggcaaggaaacaaatacaaaggagtgagggtttgtatgaaattgaaatctaaatggtttgttatttgtttagcagccgccgcgatttttacagtgacaggtgcaggccagacagatcaggctgaattccatgtagctgaaagaggaatgacgtgagaagaaaataacctgaacaaaggaaaagactgcccgggaatgttcccggcagtcttttttttgcgcggccggacttggacagcggcggaaaacaaaagaaaacgccgcaggtcaaaacccgcagcgtcctcatatagacggagtgatgcttagaaaccgccaacataggcagtacctacaataaccaacaggataaataaaacaacgatcaaagcgaaagagctgattccagaatatcctgacatgagcttcacctccatattgtctataccatacaatatgtaaaagaagctgctttgtaagggatattagtggacaagagaaaaaagaggcggtgtcctatgggagtaagactccggcgaaaaactcgtcatacagcgcccgcaccgcttgtttttcctgttcttctttcaccccgaacatcatgctgacttccgatgacccctgattgatcatctcgatgttgacgccggcttcggacagtgctttggatgccctggcggttgtgccgacattatggcgcatcgcttccccgacgaccataatcagcgccagattgtgcctgactgtgacttcatctgcttgaagttcctgcttcagacgggtgacgagcctgtgttccagttctgagtccatctgatcgtgccgaaggatgatcgtgatgtcgtcaatgccggatggaacatgttcatacgtcaatccttcttcctccaaaatgtgaagggctttgcggccgaaaccgatttcccggttcattaaatatttgcttatgtaaatgctgcaaaagcccgtgtcgcttgcgatgccgatgactggcccgttcgtattgtcacggctgctgacgacgcgcgttcctttcgcctccggattattcgtattcttaatctgaacggggatgccggcccgaaaagcgggaatcagcgcttcatcatgaaaaacggaaaacccggcataggagagctcacgcatttcccgatacgtcagttcgttaatctctttcggatgccgcacgattgacgggttgacggaatagacggcgtccacatcagtaaagttttcgtacaggtcggcttttaagccgctggcgagaatggagccggtaatatcagaaccgctccgggaaaacgtcacaatctcatgctccttcgtgtaaccgaaaaatcccggaaaaatgatcaagccttcacggtttctcagacggtacaaatgatcataagactcagggagcacctgagcgcttccgggttcattcgtcacaaacagccccgcttctttcgggcttacgtattcggctttcacgccctgccggcggaagtaggccgcgatcagcttcgcgttgttgtcctcgccgctcgctttcaccgcatccatatactgatcgggattggctttgctgctgtttaagagagcgaataggtcactgcggattctttctataatagagaaatccaggttcagctcacgcgcgatggcggcgtaccgttcaatgaccggttcggcaagctcgggcgctgcaccattttgcaaataatgctccgcacagcggattaacagatccgtcacctttgtatcgtccgagaagcgttttcccggcgccgatacgacgacggctttccgcgagggatcagccgtcacgatttgaaacactttctcaagctgggctcctgacgcaagagagctgcctccgaattttacaactttcatgatttacatcccctaatatttaaattttctcacaaatttaatttttattatctctctttcaaacatgtaaatcaaggattttttctatgtggggagaacatttgtattttcgtggaggaattttgccgctgtttgtcagatttgtttcccgcaagcgtgtcatcatgtgcaaaaaatgataagcagccaaatgaaggttatagaaaatcctgcaaattcttgatagactgattgtaagacaatttagtgtacggcccgcggatgaccgtttttgaaagcaaaactgtattgactgcgcttggaaagatgataagattatagttgtcgttgataatgataatcattacgagtggggatatatgggagttgtttggcaatcagtcataccgtttgtgatgggtgcagggaggcagcatgaagctacgttacttacttttgctactggcggttttggcgtgtacttctatatttatcggtgtagaagatttgtcgccgctggatatttttcatttaaataaagaacaggcaggtacattgtttgacagccggctgccgcgtttggtgagcattatcatcgccggcatgagcctgagcatctgcggattaatcatgcagcagatcagccggaataaatttgtatcgccgacgactgcgggaacgatggactgggcaaggctcggaattttgatttcattaatgctttttacgtcagcgagcccgcttgtgaaaatgtctatcgcttttattttcgcgttggcgggaaatttccttttcatgaaaatcctcgagagaatcaagttcaatgatgcgatttttattcctctcgtcggtttaatgcttgggaacatcgtcagctcaatcgccacgtttatcgcatataaatacgacctgatccaaaacctgtcatcttggctgcagggagatttctcactggtcgttaaaggccggtatgagcttttatatctgagtatcccgctggtgatcatcgcttatgtgtatgcggataaatttacggtggcgggaatgggagagagcttttccgtcaatctcggcctgaaatacaaacgcgtcgtcaatatcggtctgattatcgtgtcgctcatcgcttcactggtgatcctgaccgtcgggatgctgccgtttctcggtttgatcattcccaatatggtgtcgatttacaaaggggacaacctgaggagcagcctgcctcacaccgctctcttgggcgctgtttttgtgctgttttgcgacattttgggaagggtgatcatcttcccgtacgaaatttccatcggcctgatggtcggtgttatcggcagcggcatcttcctgtatatgctgttaaggagaaaagcatatgagtcataataaaaaaattacgctgctggcggcgctcgccataatatgtatcggattctttctgttctacggactgggcaattgggaatactccctgccgagacgatgcttcaaagtgcttgccatgatgctcacagggggagcgatcgcgttttcaacggtcatcttccagacgattacaaataaccgcatactgacaccgggcattttaggcctcgattccctgtatatgctcattcagaccgtcatcgtgttcctgttcggttcaatgaatatcgtcatgatgaacaaaaatcttaatttcgtcatctccgtcgggctgatggtgctcttgtcactcgttttgtatcagctcatgtttaaaggcgaggggcggaacgtgtttttccttctgcttgtcggtgtcgtgttcggcacgctgttcaacagtctgtcatcctttatgcagatgctgattgatccgaatgagttccaggttgttcaggacaaaatgtttgccagctttaacaatatcaacaccgatcttttaggatttgccggtgctgtctttcttctgacaggcatttatgtctggcggttcacgcggttttttgacgtgctgtcgctcggcagggagcacgccgtcaaccttgggattgattacgataagcttgtgaaacagatgctcatcgtcgtcgccattcttgtgtctgtctctacggctcttgtcgggccgattatgtttttaggactgcttgtcgtcaatctggcgagagagtttttaaaaacctacaggcacacgtatttaatcgcgggttccgtcctgatcagcatcgtcgcgctcgtcgggggccagttcgtcgtggagaaagtgttcacgttttccacgacgctgagcgtcatcattaattttgccggcgggatttattttatctatctgctgttaaaggagaataaatcatggtagaggtcaaaaatgtaagcaaacaatacggagggaaaaccgtccttgagaaaacgtctctatccattcaaaagggcaggctcacctcgtttatcggtccgaacggcgcgggaaaaagcacgctgctgtctatcatgagccggctgattaagacggattccggagaaatcacggtcgacgggcaagagatcggggcctgtaaaagcaacgatctggcgaaaaaaatcagcatcctgaagcagacgaaccaaatcaatatcagactgacgattaaagacctggtcagcttcggcagatttccgtattcccaagggaaactgacggatgaagattgggtgcatatcaaccaggccctcagttatatgaagctggatgacttaaaggataaatacctcgatcagctcagcggaggccagtgtcagagggcgtttatcgcgatgatcatcgctcaggatacggactatatttttctcgatgagccgctgaacaatttagatatgaagcattccgttgaaatgatgaagctgttgaagcggcttgtggaagacttcggaaaaacggtcgtcgtagtgattcacgatatcaacttcgcatccgtatattcagaccatatcgtcgcactgaaaaacggacggatcgtcaaagaagggccggcggaagagatcattgaaacctccgtgcttgaagatatttatgatatgaccatcccgattcaagagattgacagtcagcggatcggtgtgtacttttcttaaaaaccagatgaggtgaaagtcatgaaaaaattcgcattgctattcattgcgctagttacgatttttgttgtttctgcatgcggaaacggggacaaaacatcaggcaaatcaaaagaaacaatcacaatcaaagatgatctgaacaaagaaggagtcaaagtgccgaagaatccgaaaaaagtcgtcgtattcaacttcggaatgctggatacgatggatgaactcggtttacaggatcacgtggcgggacttccgaaacaaaaccttccaaaatacttatcttcatataatagtgataaatacgccaataccggcggtttaaaagaaccggattttgaaaaagtcgcggatattgatccggatttaatcattatcgcccacagacaatctgattcttataaagagttctcaaaaatcgcgccgacgatttatcttgatgatgactatacaaactacgttgacagattcaagcaaaacaccgaagtgatcggcaaaatctttaacaaagaaaatgaagtgaaagataagcttgcgaaaattgacaaatccattgccgatctgaagaaaaagacaagcagcacggataaaaacggattagtggtgatggcgaacgacggcaaaatcagcgcgttcgggtctaaatcaagatacggcttcattcatgatgtgttcggcgtcaaaccggctgacaaaaacatcgaagcctcactgcacggacaaagcatttcctatgaatatatcgccaaaacaaaccctgattacatgtttgtcgttgaccgcggaacagcgatcggcacaaaatcttcaacaaaacaagtggttgaaaatgattatgtaaaatcggtgaaagccgtgaaaaacaaccatgttgtctaccttgattcagctacatggtatttatcaggaggcggcctggaatccatggcgcaaatggtgaaagaagtaaaagacggaatcgagaagtaaaaaaagaacccggtcacatacgtgatcgggttctttttggtttaccgcgtaacggcctgctgctgctcgggctgacgcggttttttcttcaatgtaaaagataggaggaagccggccagcgcgatgcaggcggctacgacaaaggccgcattcatgccgtgcagggcggcgtttgccggagttgacgcattggcgtgcgcggcctggctgctcatcacggaaaccagcagcgccgtaccgatagaaccgccgacttggcggacggtattgttcatggctgtgccgtgcggaattaagtggcgcggcagggcgttgattcccgctgtcgtcaccggcatcataatcatggctgttcccaaaagccgtgcggtataaacgacgacaatccaaatgagagacgtcgagtccgtcagattcataaacggcagggacgtgagcaggatgatgaagaatccggtcatcgcaaggccttttccgccgattctgtcaaacacccggccgataaacggagacatcatccccatcacaatcgcgcccggcaaaagcattaatccggtatcaaacgcggagacgccccggactttttgcgtgtaaagcgggagaatggtttccgttccgatcagcagcgcgaaaacaagcgttccgagcagggtggtcaggctgaaaatcccgaaagaaaacacacggaattccagcatcggttttttgagcttcatctgtcttgcgataaagaaaatcagcgcggccgctccgacaagcagcgaagtcagcacttcagtactggtccatcctgaggaaccggcgcttgagaagccgtaaagcagcccgccgaatccgagggtcgataagatcacggataaaatatcaatctgtgtttctcgtaatgtcgtgacgtttttcatcagaataatcgctaaaagcaaatcgatgactgcgatcgggaagatgatataaaacaaagaccgccaagagaatgcttcgaccgcccatccggaaagcgtcgggccgatcgccggcgcgaacgaaataaccaagccgaccatacccatggcgcggccgcgcttttccatcgggaaaatcgtgagaaataccgtctgcatgagcggcagcataattccggcgccggccgcctgaataatccgggccgttaagagcaccggaaagttcggggcgaatgcgccgacaatggtgcccaccgtgaaaatactcatagcggaaatcaggagggtgcggctcgtaaatttctctattaaaaatgcggtaatcggaatcaaaatcccgtttgtcagcataaacgacgttgtcagccattgcgctttgttggcatctatattgaagtcattcataatgtgcggcagcgccgtgataagcagtgtctggttcaaaatggcgacgaacgctcccgccaaaagaatcccgacaatgacagagcggttgtatggtgcagttttaatactcttattcaagctgattccttctttctttatagtttgagcaatgttttaacggctgcaagcggctggtgcagcggtccggcctgctccaaataaccgatgagcgcttttataagaaaatcccgcggctgtttgtccgctgattctttctccagcataaccgccgcggaagcgagtcctgcggcatcatatttttcctccggaagggctgagacggcttctttcagttccttcaggctttcagccagcaatacggttttgtcttttggctcaaatgaggaagcggaggcggtataaaggtcaatcatctcctgaggcaaagccgtttcggttttcctgttttcgacgatgagattgagatggcggatgataaagtccgtgagcggctccagggcgagcggttctttttccagcttaatcagcgtgatgcattctctcaggagcccctgcaggacgatcaccagctcccatacataaggaataatgtcttcgccgtacgtctgaatcagtgaatcgcgatgccagcagataaaggtggagcgggccctgtgaatatgccgttttacccgctcattaatggaagaggggcttccgtacatcagcatattaaaaaactgctggttgcgcctgaagccttcaagctcagccatcagttttttggcaaaccgttcctcaggggagaggctcgtttcttcatttaataatgaagcggccgctaccatctgtttctggttaaaatcgagcagctccaggagcaggtcttcctttgattcaaacagcttatacaaagatgctttggagactttgcactcctctgcgatcgcctgcatcgagaccgacgaaaagcttttcccggaaaaaagcttccttgccgccagcagaatatccgttttcttatcattcataagcccagattccttctttcgtcacaatagaaaacccatcggttcacagaaaaccaatgagtatatgatgaaaatattaacaaaaatttttacatagtgtcaacgcttttgtttgagaaatagaaaaaacctgccggagtgttccgacaggctgatacgtttatttatccgtcttaaatccttgtttttcaagcatttcacgaatgtgaggataataaacctgcttatagtaggaagtgatgccttgtgaccagtttcttgtttcctgtccgtcggtgcgttttttcatgtattcggacatctgcttgtcataggcctcgatatgggttcttaaatcttcttcttgatacgtttcatgatgcagaacggctgcttgcggcagacgcggttttttcgcggagcggtctgccggatggccgatgacgagaccggaaatcgggaaaacgtatttcggaagtttcagcaattcaatgatttcgtcaggcttgccgcgcacggcgccgatcggcacagtgccgagtcccattgattcagccgcagccgttgccgtacccagcgcaatcccgacatctacggctccgactagaacggactctaaaccgttcgtgatctcaagcggtgtatcattatattcttcaagcgcaattttggcgcggttaaaatcagcgcagaataaaaggaaaacaggcgcttggtcaatccacggctggccgccggccaattcggatatttttttcttccgctccttatctttcaccgcaataacggtaaattgctggccgttaatggaagtcggcgctgcctgagttgcttggatgataaggtccagctgctcatccgatacgggttcatctgtgtagctgcgaatggaacggtggtctgttaatatttgaaggacttcgttcatgtcattcatcctttcgttactctgacagttctgtgcggacgacgtcaagcggcgcactcagcacttcttttgcttttgccacgaatccttggaaatggtcagttgcgttgtggaatttcatcgcttcttcatctttccattgctcaagcataacgaatgtattttcctcaccgactttttcgaaaagatcgtattgcacatttccttcttccgcgcgtgaatgctgaacaagtgattgtgcttctcctaaaaattcctcgcgtttatccgcttttactttcatgtaagcctgtaagacgatcattgttattcctcctgattgggtttatttgttatagttcgaatattatcgaactaactgtaacatgtttcgcagtgaatggtaaaggaaaaaccctcaccgcctaaattgtcacccgccgcttttatgtgttacatttgactcatgaacattccaaaccatcctgaaaccgaccgcttacagctgacaaaggttcttcatgctctgagtgatccgctccgcttagagctggtcaaacaattggcggaaacaacagaaaaaacgtgcggtacctgcgctgatgtccgggtcgccaaatcaacgctgtcccatcacttcaaagtgctgcgggaagcggggatcgcccaagtgcgcatagacgggaagcaccgttattattccctgcgcaaagatgatttacaagcggcgtttcccggcctgctggaggcgattttgcagacagaaccggaccgctggtaaataagtccccgaattccgggggtttttttatgcgtcgaaaaccgcccggtaaagcctgaggacgccatcttgaatatcgctctccttcaggcgggcgaaccccagaatgagctgcggcttatttgaatcgcctcctgctttcagacggaaccggctcatcgcaaacagatcgagctgttctgcatccgcccgtgccaaaatctctttttctgaacgggcgcagtcaaactcagtgacaaaatgaagccccgcattggcgccctttacactgattctttctccgaatatttcttctaaagccgaaatgaggcgttcccgcatgttcttataatgctgcttcatctttttaatatgtttctgatattcacctgagtcgataaattctttcagcgcgagctgggcaagcgtgctgcacgtatgcaggtcatacgctctctctttgaacgtccgcaaaagcccgggcggcagaaccatatagctgatgcgcagacctgggaaaagggattttgaaaaggtccccatgtagatgacattttgaaaccggtcaaggctttgaagcgccggtatcgtatcggcgtcatatttaaattcactgtcataatcatcttcaatgatgaagcggccgttctgttcggcggcccagtttaaaagctgaatccgccgggaagcgggcatgatcacgcctgaggggaattgatgggaaggcgtggtgatcaatacacagggccggcgtttttcgatttcggccatggacatgcctttttcatcaaggctgatcgtcgcaacctttttcccgaggttttgcagcagccggtacatcctcatatatcccgggttctccatggcgtacagcgcgtcttttggcagcagttccgtcagcagctgcgtcagcatttgcgtgcccgccccgagcacgatttgttccgggcggcatgtaacgccccttgtcagggaaataagccgcgaaatggtttcacggacttcatataagccttgcggatggacgagttccccgagtgtatgaaatgaacgggcggctgctttatgctcacagcggaaccagcttttcaggggaaaatgcgccgtatccacgctcatatgagaaaacgaaatccagccgctcttatccggctcccgctcttttaaatcttcaggcaatgagagcgaaggcgtttcttcatgataaaccgtatcaatttcctccacgaaaaagccttttctttcgactgcatataaataaccttccgaaagcagctgctgataagctgaattcactgaattcacgctgaccttcagcgtctcggcaagctcccgtttagacggcacctttgtatgaggcatcaggctgcgtttcaaaacggccgcttttatgtgctgatagatctgctgatagatataatccgccgtttccgaatgattaatggaaatcgtcagcatccagaccctgctcctttctgataccatggataaattgattttggtacttttcatcataccaaaaagaagtcagaatgataagaaaacaatatagggggatggaatctatgagtcgaacagcatcatcggaagtgacaactgcccagtggcagcaaaaacgggaccaattcgtttccaagggggtcggcaacggaaaccgcagcatggcggtaaaaggggaaggggcgcttttgtacgatttggacggcagacgattcattgattttgccggagcgatcggaacgctgaatgtcggccattctcatccgaaagtggtggaggccgtgaagaaacaggcggaggatctgattcacccgggatttaacgtcatgatgtatccgtcttatattgagctggccgaaaaactttgcgcccttgcgccgggagatcatgcgaaaaaagcgatttttctcaattcgggggcggaagcggtggaaaacgccgtgaaaatcgccagaaaatatacgaagcgccaggctgtcgtgtcatttacaagagggttccacggccgcacgaacatgacgatgagcatgacgagcaaggtgaagccttataaatacggtttcggcccgtttgcctcagaggtgtatcaagcgccgtttccttactattatcaaaagccggccggcatgagcgacgagcagtatgacgactttatcatcagcgcttttgaggatttctttatcgccgcagtcgcaccggaaaccgtcgcctgtgtcgtaatggagccggttcagggagaaggcggcttcatcattccttcaaaacgtttcgtgcagcacgtcgccgctttttgtaaaaaacacggtatcgtttttgtagcggatgagattcagaccggttttgccagaacgggaacgtattttgcgattgagcatttcgaagccgttccggatttgatcaccgtatccaaatcacttgcggccggattgcctctgagcggtgtcatcggccgggcggaaatgcttgatgccgccgcgccgggggaactcggtggcacatatgcgggaagcccgctcggctgtgcggctgcgctcgcggtcttggatattattgaagaagaagggctgaatcagcgttccgaagagatcggccggatcatcgagcatcaagcgatcgagtggaaaaaagagcatgcctgcatcggagaagtgcgcagactcggcgcgatggcggccatcgaaattgtcaaagatccgtacacgcgggaaccggacaaagcaaaagccgcggcgatcgctaaaacggcgaacgagaacggactgctgctgctgacggccggcattaacggcaacattatccgattcctgacgccgcttgtcgtgacggatgagcagctcaaagaaggcctttccattatcgaagcagctctgtgagttcaattattggaatcccgccggatgtgtctgctatcatgaaagtgtgagatacatcaacaagcattcaatggttttactataggaaagaaaggaatgttcaatatgccagaacaattaacagtgtacaacccggcaacgggagaggcgatcgaaagcatcccccagcagacggccgaagatgttgaaaaagcgattgaacgttcacatcaagcgtttcaatcatggtccaaaacatcagcgggagaacgtgcctcacttttgagaaaatggtatgagctgattgttgaaaataaagaagaacttgcggaattaattacgaaagaaaacggcaaaccgtacgaagaagcggtcggagaagttttatacggcgccggctatattgaatggttcgccgaagaagcaaaacggatttacggcagaaccgtacctgcgccgacaacgggcaaacggattgtcgtcacccgtcaggcggtcggcccggtagccgcgatcacgccgtggaatttcccgaatgcgatgattacaagaaaagccgcgcccgctttggcggcaggctgtacgttcatcatcaaaccggcggaggatacgccgctttccgcttacgcccttgcgcgtctcgcatatgaagcgggaattccgaaggacgtgctgcaagtggtgatcggtgacggagccgaaatcggaaacgtcttcaccagcagcccgaaaatccgtaaaattacctttaccggctcaacgcctgtcggcaaaatcctgatgaaaaacagcgccgacaccgtaaaacatatgtcaatggagcttggcggacatgcgccgctgatcgtggatgaagacgctgatcttgatctggcggtagcccaaacaatggcctctaaattcagaaatgccggccaaacctgcgtctgtgcgaaccggctgatcgtacacgaatccgtgaaagacgagtttgcgaaaaaactgagtgaagaagctgcgaaactcaaagtcggaaacggtcttgaaaaaggcgtaaacgtcggccctgtcatcaacaaaaaaggcttcgataaaatcgtcgggcaaattaatgacgccgtggaaaaaggtgcagaagtgctgacgggcggaacgtatgaccaaaacgacgaaaaaggatgctatttcgtgacgccgaccgtgctttcaaatgtagatacatccatgaacatcatgcatgaagaaacattcggcccggttgcgccgatcgttacgttctcagatattgatgaagcgatcaagcttgcgaacgatacgccgttcgggcttgcggcttatttcttcacagaaaactaccgccgcggcatctatatttctgaacagcttgaatacggtatcatcggctggaatgacggcggtccgtccgcggttcaagcgccgttcggaggaatgaaagaaagcggcatcggccgtgaaggcggtacggaaggcattgaaccgtacctggaaaccaaatacatgtctatcggactttaatgagccgaaaagaaagccccgcttctaagcggggcttttttattgagcggtctgccggtgaatatcgccggcaggcttttttgatcttgcgggaataatcggttcgattccagacaaaataacagcaaatacgattgaaagaaggtcgccatcatggatatattactggctcttctcccggctttattttgggggagcatcgtgttatttaacgtcaaattaggcggcgggccttacagccagacgctgggaacgacaatcggggcgctcatcgtttcgtttgtgctgtatctgtttgtccatccggtgctgtccgggcgcatttttattgtcggcatcatctcggggctgttttggtcgctcggccaaagcaatcagcttaaaagcatacagctgatgggcgtttcaaaaacgatgccgatatcaacgggaatgcagctcgtctcgacttctttgttcggtgtgatcgtattcaaagaatggtcaaccccgatcgcgattacgctgggtattctcgcccttatttttatcatcatcgggattgtgctcacatctttagaagataaaaaggggcgggcggacggagaaccgggaaacttaaaaaaaggcattgtcatcctgctgatctccacgctcggctatttggtctatgtcgtcgtcgcccggctgttcggtgtatccggatggtcagcgcttctgccgcaggcgatcgggatggtcatcggcggactgctcctgacgtacaagcataaaccgtttaataagtacgccctcaagaacattctgccgggaatcatctgggcgctcgggaacatgtttctgttcatctcacagccgcgcgtcggagttgcgacaagtttttccctctctcaaatggggatcgtcatcagcacgctcggcggaatcttcattctccgtgagagcaaaacgaagcgtcagctggtcgccattgccatcgggattatcctgatcattgtagccgcggtattcttaggcgttgcgaaatcaaattcataacatatgcaggaggtttgaacatgtacacggatttaaaaggaaaagtcgttgccattacgggagcttcatcaggattaggaaaagcgatggcgatccgcttcggacaggagcaggcgaaagtcgtggttaactactatagtaatgaaaaagacgcccaaaccgttaaagaagagattcaaaaagcgggaggcgaagcggtcatcgttcaaggagacgtcacaaaagaagaagatgtcaaaaacatcgtgcagaccgcagtgaaggaattcggcacattggatgtcatgatcaataacgccggcatggaaaatccggttcagtcgcatgaaatgccgcttaaagactggaacaaagttatcaataccaatctgaccggcgctttcttaggaagccgcgaagccattaaatattacgtagagaatgatattcaaggaaacgtcattaacatgtcaagcgtacatgagatgattccgtggccgctgtttgtccactacgcggcgagtaaaggcggcatcaaattgatgacggaaacgctggcgcttgagtacgcgccgaagcgcatccgtgtcaacaacatcgggccgggcgccatcaatacgccgatcaacgcggaaaaatttgccgatcccgttcagaaaaaagatgtggaaagcatgattccgatgggatatatcggtgagccggaagaaatcgcggctgtcgccgtctggcttgcttcaaaggaatcaagctatgtgaccgggattacgctgtttgctgacgggggaatgaccaaatatccgtctttccaggcaggccgcggataagaaaaaaagcgatcgcaggctctttagagccggatcgctttttgcttacacacgttttttctttacaagcgccgcgatggaaaggataattgccgcagctgacagaacgatggccgcaatatcaagcgctgatacgccggatttgctttcttcgtttgactgttcagctccgtgcgcatccgtcacgctcgccgatttcgttattttcgtaatcgagtgaggcgtgtcggctttctcatcacccgtccattctacaatgctgccgtctttgtaatattggtaagcgtcccaagcggcatctccgctcttttcaggatttttcgcaacgaacgtgaactgctggaattggccgggctgaatgccgccgtcctttgcttcccaagtgacggagaccgctttgtcatcatgtttggatacggatgttttccagcccggaatcggctgatactgctgaaattcaacgccggcgggcattttcagcacgactttcgttgtcggctcattcttttccacaggcactttcatcgtgtacgtttcccaagaaccggccgcggattccgcgggtttgactgagacgtgggcgcttgctgcagccgtaaaaccgacgagtgacagggtcacggcggatatgaatattaaagctttttttttcaacatgagatacactccttagtttgtcgttgagaatatttggttgatttcattaaaatcgtttgtcagtccgtggactttgatcttccagtttcccttttcggtgatggacaggttggcggcttcgaatgtgccttccttcgtcttcttcaaatcaaaggtgctttcatgctgtttgccgctgaagcccgtctggtaaacagtgaccgtaaattgctgaatgtcttttactaagctgccgttatgatcggtgacaatgacttgaaattcatttttacccggctggttcggcgtaatgtgcaaggatagggtttccccgtttccgatcgtttctgagccgttaaaaggcaatggcgcgggcggaggcggactgggcaggcttgtgaagacggcggttgtgaataacaccgcaatgcctagtgcccattcggcctttatcgttgcgctgatgctcctttttctgctgaacttcgtcatccatacgtgaacggcgccgagcgcaagcatgatgacaaacagtccgattttcaaaaggagcgtcttgccgtaagcggtgtgaaagagtgaatcgaacgagcggataatgaaaaatccattcagcactcctgaaaataacagcacgccgacagaggcgaacgcccaaggagaaaaccgtctgaccgtttcccaagcgatggttttatcgggttctctccactctgatgaaagaagcagcacaagcgcggcgataccgcccatccatacagacgcggccgataaatggagaaagtccattgcgatgccgaccgctttttcgtcgataacggccgcatgcccggcgaatgcttttgccaaaagcgaagcgaagaagaataacagcggcgccgtccagtacgcaaatgaccggaatgctttcttcttcagcagcgggatcatggacagggcgagcaggataaataagctgatctggatcatccagacgtacccgcctgccgttttcagaagcgtttcttttacatagtccggctgaaacgcggcgctccaagcgccgcccgcgttttctttcgtctggatcgggagctggcacacgagcgcgagccccgttaaacataaagaaatcacgagcagctttacagttcgttttgcttttgatgaatcttcattatttctgtaccaaaacagatggaaaaaagccgtgccgataaacagggagagagcggtgtacaaaataccgcggtcgatggccgcttcgggatgaagcgccgcttgcgatgatgtctgctcctgaagttctccgccggcttttccgatgctgaaagggatgacgccggataccggatgtccgtcggccgataccgcgttccattccgctctgtaaatatcatgcggcagattttttttcaatgccgcggtcatgatgcgggcattatttttttgaatcaccgttttgcccgcgtcaacccgttcaccggatgaattatagaccttaatggagtggaagccttcttcaatctgttcattaaactcaatttcaatctgcttcggcgcttgttttaattcgctgttctcacccggatttgagtttgtgatgtaggcgtgggcgaagcttgttttcggaatcaaaacaaggaacagcaaaaagacgagccagcgtttgttctgtctcatggatgatgacaccgccttccggttggttgttgttatgtcttgctgcaggtgcatcccttctgcctgtcgtgtaagatgatgtccgccgcctcgtcaaaggtgcaaatgaccccgccgaatcctttttgaaaccgttctgcgtaatcaagcgttgagaagggaatcgcctgaggccggcagcagtgaaggtcaatatcggcatggactaaaaagtatgcggaagctgccgttagcgtcgtctgaagaagaaaatccttacaaatgacgtgggacacttcatcctttttatcctcataccgcaaaatcgcgcaatgaatgcagcacatctgctcaacggtttgtgaaacggtaataagctgaacagaatacgaatgctgaatcggccgcaggcaatagccgcattgattggcgcttcgttctgaagcgggagggagcgtaatgccgccgggtgtccggataatccggtttgcatccgccagctgattgacgtctctgtacacggtcatctcggagacgccgaatctctcgcttatgtcagagattttcagcgcgccctcttctttcagccattcaagcaaggtttgctgtctgtgaatcggaagcaattctgcatcctcctttttatgcgaatgagtgatgaacctccctctaagagtagatgttttcacaaatgcacacaagagcctgatgataaaatatgtgaaaaaatgttgaacaatcacaaatgtaaaacacgcagtcagactctgttataatagaagagttgaatggaggaataaacatgaaagaaacgacctgcccgaactgcggcaagccgattacaggcgacatggtcagatcatcgatgatcccgtgccagtttcagtgcgggcattgccatgtgaaattgcgtgaatataaagtatcagctccgattatggctgcggccattgcgatcacggtgcttttgatttatcttgtgcagatggccagaaccgccgtcatgccgatgtttccggcagcgcggtatgtgccggccgccattttcgcgctcgtatgtgcgtatccggtgtttattgtcagtgagcggctcattgccaagctcgtcgtcacaaaaggacacattatatacagaaagcggtaagacacctttgatgaggtgtcttttttttgttaaggatttgtcacagtctctgtgccaaactcctctttacttttcattgaatggggattgtaagcgttttatgatgaagacacaggggagagagaaaccccgtgtcttatttattttcatctgaaggcaggcaaacagggagggaatgaacatgcagcaagaacagcaagctggcatgaaagtgaagatacagcggttcggcagttatttaagcggtatgatcatgccgaatatcggcgcatttatcgcatggggaattatcaccgcgctgtttatacctaaggggtggtttccgaatccgcagctgaatacattggtaagcccgatgattacgtatcttctgccgcttttaatcgcatatacgggcggaaaaatgatctatgatcaccgcgggggagtcgtcggagcgacggccgccatcggagtcattgtcggagcggacattccgatgttcttaggggcaatgattatgggacctttgggtggttatctcattaaacaattagaccgtctgtttaaagataaagtcagacagggttttgaaatgctgatcaacaacttcacggcgggaattatcggcgcggtgctgacgattatcgcgttttatgcgatcggcccggtcgtcctgtctcttaacaaattgctggcggcgggtgtggaagtcattgttcacgcgaatttgctgccgattgcaagcgttttcgtagagccggcgaaagtcctgttcctgaataacgcgatcaaccacggcattttaagtccgatcggaatcgagcaggccgccaaagcgggaaaatccattctgttcttagtggaagcgaaccccggaccgggactcggtattttactggcctatatgttctttgggaaaggctcttcaagatcgacagctccgggagcggcgatcattcatttcttcggggggattcatgaaatctatttcccttacattttaatgaaaccgatgctgatcctcgcggcgatcgccgggggagcgagcggactgctcacattctcgatctttaacgcgggtcttgtcgccgcatcatctccgggaagcatcatcgccattttggcgctgacgccgaaaggaagctatctcggcgtgctggcgggcgtcatcgtggctgcggccgtatcgtttatcgtctcggcgcttattctgaaatcgtctaaagcgggcgaagaagatttgacagccgcggcggaaaaaatgcaggaaatgaaaggcaggaaaagtgaagcggcggccgcattggcagacaaagaggaagagccggaaaacagcgccgctgatatttccgctgaccaagtcagccgcattatcttcgcatgtgacgcgggtatgggatcgagcgcaatgggcgcctccattttaagaaacaaagtgaaaaaagcagacctggatattgatgtgacaaatacgtcgatcaataatcttccgaatgacgcggatatcgtcattacgcataaggacctgactgaccgcgcgaaagcgaagctgccgcaggcggtgcacatttcggttgataatttcttaaacagcccgaaatacgatgaactgattgaaaagcttaaaaactaatcaaacagaaagagggatcttcatcatggaagtattggctaaagcgaacatcaaactgaaccagacagtgaactcaaaagaggatgccatccgcctggcgggacagacgttgattgataacggttacgtgaagaacggctatgtggaaaaaatgttcgaacgtgaagaaacatcatccacgtttatgggaaatttcattgcgatcccgcacggaacagaagatgcgaaggatgaggtgcttcattcaggcatttccgtcatccagattccgaatggtgtggaatacggtgaaggcaatacggcaaaggtcgttttcggtatcgccggaaaaaacaatgaacacttagacatcctgtcaaacatcgccatcatctgctcagaggaagaaaacatcgaacggctgatcaatgcaaagacggaagaagaactggccgctattttcagcgaggtgaactgacatgattgcccttcatttcggagcgggaaacatcgggcggggctttatcggcgccctgctccatcattccggctatgacgtagttttcgctgatgtgaatgaaacgatggtcagccttctcaatgaaaagaaggaatataccgtggagcttgccgacggcggcaggcagacagaaatcatcggccccgtttcagccatcaacagcgcggtgcaagaacaagagctgtacgggctgatcaatgaagcggcgatcattacgacggcggtgggcccgaacgttctcagactcatcgccccgtccatcgcggaaggtctgaagcgcagaacgtcctctgagcctctcaatatcattgcctgtgaaaatatgatcggcggcagcagttttctgaaaaaagaagttttcggacatttgacggaagcggagcgggaactcgtgaaccggacagtcggcttcccggattctgcggtagatcggatcgtgccgattcagcaccatgaagatccgctgaaagtatccgtagaaccgttttttgaatgggtcatagacagaaccggctttgccggcgatcagccggtacttaaaggcgcgttgtttacggatgatcttacgcctttcattgagagaaagctgtttaccgtcaataccgggcatgccgtcacggcgtatgtcggctatcagcgcggattaaaaaccgtcaaagaggccatcggccatccggaaatccggcgtgtcgtgtacgatgcactttcagaaacgggcgagtacttggtgaaagcgtacggctttaagcaagccgaacacgagcagtacatgaaaaaaatcatcagccgctttgataatgaatacatcacggatgatgtgacaagagtcgccagatcaccgctcagaaaactcggagcgaatgacagattagtagggccggccaaaaaaataaaagaaccgaatgcgctggcggaaggtatcgccgccgccctgcgctttgactatcaggatgatccggaagcggttgagctgcaaaagcttatcgcggaaaaaggcacgagcggcgttcttcaagacatttgcggtattcagccgcatgaaccgctgcacggcatcgtgctcaaaaagctcaatcaataaaaatgaacccgcgtcggggggacgcgggttttttcttgcgttataatgagagggaagggaggctgcgtgatgaatcagaagctattgccccatcgttttccgtttcttttgattgacggcacgacgaacagtgaagccggaaaatgggcggctgcttacaaaaacatcagtgaaaatgactggtttataactgaataccaaagagagatgccattttcgctcgtcgttgaagcaatggcccaaacggcggcttgcgcgggaattaccggcggtgacggtctcggtctcttatccgcggtgaagaaagcggaaaggttaggtgccgctttgccgggagaccgtctggatcttttttttgaggtcacgcgaatcagacgcggttttgtgttcggccgggcgaaagcgtccgttgccgggaagcctgtggcggaagcggagctcagcatatttatccagccatcgtaaaaaaagccgcctccaccggcggctttcggacaagcgtgttattttgtatcataatctctctcactttgtgaattgtccctctggtcatgtttgtgtttttcgtcattggcgttttccttcagctcttccagcggaatcggatccgttaaatcatgatgttcaggattttcattcggtttgttcttttgttttctttctttcatcctccatcacctcaatatttcttttcctcaacgctcgccccgccaaacgcaggaagcggttttttgttcctgtgggtcatatgtattaaaatagagacgactacaatataaaaagtgaggtacatatatgccgatacaaagagaagacgcagatattaaactgatcgcgattgatatggacggaaccctgctcaatgacgagcagctcatcccggaggaaaaccggcgggcgatcaaggaagcggaggcgaaaggaattcacgtcgtcatcagcacaggacgcacgctgatgacctgccgcgaactggctgagtctctcgagctgtcatcctttttaatcacggcaaacggcagcgaaatctgggattccaactttgagctggttgagcgcaagcttcttcataccgatcatattcaaaaattatgggatctgaggaataagcacaacacgaatttctgggcctctaccgtcgatagagtgtggagaggggaattcccggaaacgattacggatcatcagtggctcaagttcgggttcgaaatcgaggatgatgaagtgcggaatgaggtgctgaaagagctcaaggaatacaaggagctcgaaatcacaaactcaagtccgatcaacatcgaagtcaatgccctcggtatcaacaaagcggctgcgctggcgaaggtatcggaaaaactcggcttcacgatggaaaatgtgatggccatgggtgacagtctgaatgacattgccatgatcgaaaaagcgggtgtcggcgtcgccatggggaacgcgcaggacatcgtgaaagaaacagctgactgggtgactgatgtcaacacggaaaacggggtcgccaaagcgatccgccactgggtgttataatagaaaaaagagagagtctcagcatgaggctctctttttttgttttgtcagatttgtgactaggtccatggtaggttttctgacaaaaggatgttcaaacttgtcagaattaaatataatgaagagaaatccaacaattcggaatagtcgttccaaatatcggaatgataataaaataaaacgtttacaatacaggagggagcttatgtttcagattgacatcaattgtgatttaggagagagtttcggtgcttataaaatcggactggatgaagagattttggattatgtgacatctgcaaacatcgcctgcggctttcatgcgggtgatcccagcgtgatgcgcaaaacggttgcgcttgcggcggaaaaaggcgtgaaaatcggcgctcatcccgggctgttcgatctgcagggattcgggcggcggcagatcgcgattacgcccgaggaagcgtatgatctgacgctgtatcaaatcggcgcgctgtcagggtttttaaaagcggaaggtgtcgagatgcagcatgtgaagccgcacggcgctttatataatatggccgccgtcaatcccggcctgtcaaaagccatcgctcaggcggtctgtcattttgatcccgggcttattcttttcgggctttccggaagcgagctgattaaagcgggagatcgaatcggactgaggacggcaagcgaagtgtttgcggaccgcacctatcaggaagacggcacgctgacgccgcgttcagagccggatgcgctgattcaggatgacaaaaaagcggtcggtcaagtgattcaaatggtgaaagacagcacggtgacatcacgtaagggacaagctgtaaacctgaaagcggacacggtctgcattcacggagacggcgcccacgcgctgacattcgcaaaaacaatcaaaaaagaattaaaagcggcagacattcaaatcagcgcgcttgcaaaagactgagcagcagagggaggaagacagcatggagcaaaagaaaaaaacagccggaaaggcttccggcaaatggtcgcttcttttaggcgcgacatttttgatggcgacatcatcaatcgggcccggctttctgacgcaaacggccacgtttaccaatacattggcggcaagcttcggctttatcattttaatttctattattttggacattttcgcgcaaaccaatgtatggcggattatcgcggtttccggaaagcgcggccaagagattgccaatatggtgcttccgggcgccggttatgccattgcttttctggtcgtgctcggcggacttgcgtttaatatcggaaacatcggcggcgcgggtctcggtcttcaagtattattcggaatcaaaccggagatcggcgctttaatcagcgcagcggtcgcggtgctgatttttgtcataaaggaagccggaaaagtcatggaccgttttatgcagatcgccggaatcgtcatgatcgtattgacggtgtatgttgccgtaacgacgggtccgccggtcggacacgcggttgtaaaaacttttatgcctgatcatatcagtgtgctggcaatcgtgacgcttgtcggcggcacggtcggcggatacattacatttgccggaggccatcgcttgcttgattcaggcatccaagggaaggaagtcattcctcaggtgacgaaaagctccgtcacaggcgtcttgattacatctgttatgcggattgccctgtttctcgccgtgctcggcgtcgtttcaaagggcctgcgcatcgatcctgataatcccgcggcttctgtattccggcttgcggcgggaaatgtcggctataaaattttcggcgtcatcatgtggtctgccgctatcacgtctgtcatcggcgccgcctatacatcggtgtcattcttcaaatcgttttcggcaaaaatcgaaaagcactcacatggcgtaattatcggttttattattgtatccactcttatttttgtcacgatcggccagcctgccaaaattctggtcgcggtcggttcgcttaacggcttaattctgccgcttgcattagcgatgattctgttgggcgcctataagaaaaaaatcgtcggcgattacaagcatccgatctggctcacgattgcaggggcgatcgtagtggttgtcatggcggttatgggcatctatacattattctcgcaaatgccgcagctatggagctgatgatatgaaaaaccatatgagtgatatgagtcccgaagaagtcagacagcttatcaggaaagggcagatgaccgggccgacggcggggttggccgcttcttacgcacaagccaatctcgtcgttttgcaaaaggatcttgcctttgattttctcttattctgccagcgtaatcaaaagccttgtccggtgcttgatgtgacggatgcgggttcacccgttccggcaatagcggcgccgggagctgatatccggacggactttccgaaatacaggatttatcggcatggcgtgcttactgaagaggtaacggatattacgccgtattggaaggataattatgtcgggtttttgatcggctgcagtttttcattcgagcaggcccttattaatcagcacatcccgatcaggcacatcgatgaaggcgtgaacgttcccatgtataaaacaaatattgactgtattccggcgggcccgttttcaggaaaaatggtcgtcagcatgagaccgattccggaaaggctggcagtccgcgcggcgcaggtcacgtcacgttttcccgccgtgcacggcgcccccgtccgcatcggaaatccgcaaagcatcggcatcagcgatttgcatcagccggatttcggagatgccgtaacggtgcgggaaggtgaagttcccgtattctgggcttgcggcgttacaccccaggcggtgatcatggaagcaaagcctgatatcgtaataacacattcaccggggcacatgctgatcaccgatatacaaaatgaatcgcttgctgtcctgtaagtgagaaagaatacaacgaggtgatgacaatgatgcagtatagcggaaatacagcgcttgatatacagccgtacggtgattccgccgttatcatccgctttggcgggcacatcagcgaagaggtcaacagccgggtgcaggcggcggcagcctgtatggaagaacggccgtttccgggcttcgttgaatgtattccggcattcacaagcttaacggtcttttatgacgtgtctgccgtctcaaacataaaaaaaggcgtctctccttttgccctggtcaagaaagaagtgacagaacgtctcagccatataatgaccggccgcaaaaaagagcgccgggtgatggaaatccccgtttgctacggcggagatttcggtcccgatttagaagaggtcgctgaaatgaacgatctgaccccggaagacgtcatccgcattcatactgaaggcgaatatctcgtttatatgcttggatttgcgccgggatttccgtttttaggtggaatgtctgagcggatcagagcgccgagaaaggcgtcgccaaggccgtccatcccggccggttcagtaggaatcgcgggaatgcagaccggtgtgtatccgatatccactcccggcggctggcagctgatcggcagcaccccgctccggcttttcaggccggaagaacatccgccgagtctattgagagcgggtgatacggtgaaattcgtccggatcacagcagaggagtacagccgcatcaaggagggagccgaatgagtatgaaagtggtaaaacccggtctcttgacgacggttcaggacacggggcggacgggatatcagaaatacggtgtgctgggaagcggcgcaatggatacgatctctctgcgcatcgccaatcttcttgccggaaatcaagaaaaagaggcggggcttgaagttacgcttatggggccagggccttcctttgagttctcagaacccgcggttattgccgttacgggggcggatttcgcctttcatattaatggggagcccgcccctctgtggaaaccggttttgataaaggaaaacagcgtcgtctcattcgggccgtgcaagatggggagccgcgcttatctcgccgtcgcggggggatttgatgtgcccgccgtcatggaaagcaaaagcacgtatgtcagagcggggatcggcggcttttgcggaagagcgctgcaaaaagatgatgagctgccgctcggccgtatgacgccatgttcggaatcaatcgcgtaccgtctgagcgattctttcggacagtatggtttctcagcgcctgattggtctgtcagcagcagagggtttctgccgctgaaaaaaaatccggtcatacgagtgcttgaaggcgctcaatttcacgcttttacagaagaagcaaaattacgtttttatcaagagtcatatacggtcacgcctcaatccgaccgaatgggctaccggctgaagggcgctccgcttgaattgcgggagccgctggaaatggtatctgaggctgtgacgttcggaacggtgcaggtgccgccggacggcaatccgattattctgctggctgacagacagacgacggggggctatccgcgaatggcgcatatcatatccgccgatcttcccctcgtcgcccaaacgatgccgggggaacatattacgttccgggccgtttcgctggaggaagcggaaatgctgcttttggagaaggaacagcagctgaaggagctgaaagcaaggctcaaaatggaatggctgatctgacaaaggggctaaagaccatggaaaacaaaaacaaaaccgtcatcaaatcaatggaactgcttcatttgtttctcactgaaccgagcctgagcttaaatgagctggtttctctatcggaaatgccgaagacttcggttcaccggatggcaagctcactggaggaaacagggtttctcacccgggcggcggacggccgttatcagcttggtctgatctttttacaattcggccagctcgtctctgaacgtctggatatcaggaaaatagccaaaccgattatggaagagctgtgcagcgaagtggatgaggccgttcagctgatcatgagggacggggatgaagccatttacgtcgaaaaaattgaaggcacccaaaccgtccgcctgtatacggcaatcggccgccggtcgccgctgtacgcgggagcttgcgccagaagcattttatcgtttctgccggaagaggagattgacacatacattcagaagacaaagcttgccgcaatcgcctcaggcacgatgacggatcgggctgaactgcttcactccattgaaagatccttgcaatcaggttatacgatcagctattcggaattagaagattatacggcggcgatcggggcgccgattttcaatcacgaaggtaaggtggctgctggaatcagcatcgccggcttcgaagcccggttttcagaggacaggctgccgtatttaaccgaaaaggtcaaaaacgccgcacagcatatttctgagaaattaggttattgaccgagccaatttttcttcactcgcgtacattacaatatcgatagtaacgagtggaggaaagtaaatgggacttgtttatacggcgctgggggattctttgacgacggggaggggatccgggccgttttccgccggttttgtccagcggttcgggcgcatgatggcagaagatttacagacaagaaccgacgtatccatctttgccaaatcaggccttgagacgggagaaattctcgggcttatgtccttcccgtacattcagaggcggattcaggctgctgatatgattacgattacaggctgcggcaacgatttgatcgattcggttcaggcatatcagcaaacatcggacgcttcggtattcaccagcgtgtccagtcactgccatgagaactttgaaaagatgataaccaagattgctgccttaaaagggtcgcacccgtctccttatgagatccgcgtcttcaatttatacaatcctttcccgggcatctccattgcagaaaaatggatatcctcttataatgcgcacctcagcacactcgcatcggcgccgcacgtcaaaattgccgacgtccacagcgctttcaaaggaaaaatgaatgaatatctttcttatgaccgcgtacaccccaacagcaaggggtatgaagtcatggcatgcgtcctgcgggggctcggatacggaagcctcgcccgctcataaaccgcgcgctccttttcatggggagcgcgcttttcgtgctccttaaaacaaacttaaaattgtccgactttcgttctatccgcgcaaaaagtacgctagaataatgggggataaagacagaaatagaattgtgttcaaaaaatgataacagaaaggatggattgctttgctgcgcgccttaaaactgtcactcgcgatgctgattattatacttgcggccgccgcatttacgtatgcggaacatacctccgtcatacagccggttatgctcgtgtttctcggtgcggtcatgttcattcaggggctggaggaaaaacggaaagaaaacgacggctccgggaaattcaatatctataccgccgtttttgtatggtcgatctccttaatcggttttacgcttcacgcgatctgagtctgatagatcctgaaaatgctccacaacgggaaatggtgaataaaaacggtgcagtaaggctttccactcctgatattccggcgatccgcgaaagccttttgtatgatcttctaatgtctcccattccacaagcagcaaatatttatgcgtcttttccatacatttggacaaggaatgggacagataacctttcatgcccgcgataatcggctccgcccggcggaatgcctcttcgaattccccctcaagaccttcttttacatacagcatggctgcttctctgatcatctgaaattcctcctttttttaatagatacattgtataaaaatatgggccgtgacggccggaaaaacaaaaaaattttaaacgctatgagaaaaaaatccttgccagcctgatttggtttaggagaaaataacagttggaaggcaggggaattgacagtgaaaaaagggttatacctattacttttactcgcaggaatcataggtttgatcggctgctcgaaaacggaatcggccgaagacagaatgaaagatttcgtaaaagactggaacggcggtcattacgataagatgtaccaaagcctcacccaggatgaaaagaaaaaacgatccaaaaaggattttgtaaaacgatatgaaaccatttatgaacaagcaggggtcaaaaatctgaaagtcactgccgaaaaacaggacgaagacgataagaaaaaagatgacctccagcacatcgattataaagtcagcatggatacaaaagcagggaaggtcgcttttgaaaacacggccgtcctgaaaaaagagaaaacagacgatggagaatcatggaacattgactggaatccttcttttattttcaaacagctttccgatgacaaaaccgtgcagatcgcaaatgaggaaccgaagcgcggacaaatttacgacaaagacggaaaaggtctcgccgtgaataccgaggtgccggaaatcggcattatccctggaaaactcggcaaggataaagacagcgtgatccaaaaactgtctgaaaaactggacctttctgaagacgatatcaaaagcaaactgaaccagggctgggtaaaagacgactcctatgtcccgattcaaaaaatcagaccggatgatgaaagcaaggtcaaaagcctgcttgcattagacggcgtgacgaaaacgaaagtcagctcccgctactatccgtacggcgaaaaaacggcccatctgaccggctatattaaaaccatcacagcggagcagctgaaaaaagcgaaagacggccaatacagcgatacttccaaaatcggcatcgccggccttgagaatgtatatgaagacaagctgcgcggcaagaccggctggaaaatttacgtcccgcaaacaggtgaggtcattgctgaaaagaaagccgaaagcgggcaggatattcatgtaacgattgacatgaaaacgcagacgaagctgtatgattctatgaaagatgacagcggagcggcagtcgccctcgaaccgcaaacgggagagacactcgcgctcgtcagcgcaccgtcttatgacccgaacggctttcttttcggctggagcggaaaagagtggaaaaagctgaatgaagataaaaacaatccgttttcagcgaaattcaacaaactttatgcgccgggatcaacgattaaaccgattgccgcggcagtcggcctgacaaacggcacattgaaagcatcggaaaagaaaaaaatcaccggaaaagagtggcagaaagattcgagctggggcggttaccatgtcacacgcgtatcagagcgcctgaatgaagtggatctcgaaaacgcgctgatcacatcggacaacatctactttgcgcaaaatgccatagatgccggagcggacgcgtttacaaaaggattaaaaacatttggctttgatgaagagattccgtaccaatttccgattgaaaagtcctcaatcgctaacggcaagctagattccgagatccttctcggagatacgggctacggccaggggcagatgctgatgtctccgctgcacttagcggctgactataccgcatttgtaacagacggaaatctcgtcaaaccgacattgatcaaagacggagaaaaaacaccgcaaatctggcataagcaagtggtgtcgaaagccaatgccgaagaaatcacgaaagggctgagaggcgtcgttgaagatccgcgcggctctgcatatcagccggccgtaagcggcattaccgtagccggaaaaaccggtacagccgagctgaaaacgtctaaagaagataaagacggcaaagaaaacggctggtttgtcggttacgattataaaaagaaagacctcttgatcgcgatgatgattcaagacgtcaaaaaacgcggcggaagccattacgtcgttgaaaaagcgaaaaagcagtttcagaatcattaaatgacgatttttgcgggctgaaaggaaaatcggccgccgaagcagaatgaaacagcatgggcaattcctgaaaacagagatacaagaggctctaagaaaaagggggatttcacatgcagcgcattcaattggctgaagacctggaattttcaagagtgatacacgggctttggcgtctgaacgaatggaatgtttcagacggagagctgctgaatctgattgaatggtgtatcagccaaggcatcaccaccttcgatcatgccgatatatacggcggttatacgtgtgaaaagctgttcggcggcgctttgtccctttcgccttcaataagggagcgaatcgaaatcgtcacaaaatgcgggattgtcattgaatcaccggagcggccaggaaacaagtcgcatcattataatacgtcgaagtctcacatcttagcgtcggcggagcagtcgcttttgaatctgaatacggattatctggatgtgctgctcattcacagaccggacccgcttatggacccggaggctgtggctgaagcgtttcacgcgctgaaaagctcgggcaaggtcagatatttcggggtatcgaactttaaagcgcaccagtacagaatgctcgaatcctatttggatgatccgctcgtcacaaaccaaattgaaatctcggcgtacaagctggaaaatattcatgacggcacgctggatttctgtctggaaaaacgcattccgccgatggcgtggtcaccgcttgcgggcgggagcgtctttacaggacaatcagataaggccctccgaatccgtgccgcgcttcgttccgtacaggaagaaatcggcgccgcttccattgacgaagtcatgtacgcatggctgttcacccacccggcagacatcatgccgattgtcggcagcggaaaagagaaccgcatttccgccgcggtgcgtgcatccgcgtacaaactcagccatgatcagtggttcaggatttataccggtgtccaaggctgcgatattccataaacagaacaaacgcccggaaggtatcttccgggcgtttgtttatgtggtgtgcaatgtctaaaaacaagtaaggtcactttgaagtatagccgtgcggatcaagagtaacaagcgtcatggcatattatctgacacatttttctttttcaatactgtcacacggtccagtgccaaattgccatttgaaaatggttgaataatcattgaaagcgttttatattataatttacaccactttccccggcagcactccccatatgccatacttctcacaactagaaaatctggaggcgcgtttcatgtatatgacagcgagagaacaaaaattaatgaaacatctattactgcagaaccgttacgagacagtgcatgaactggcagaagctttacaagtcagcacaagaaccgttcaccgcgagttaaaaacaatcaaaccgatgatggaatcattcggtctggcacttgataaacagcccggcaaaggactgaaagcggtaggaaacccggaggacaaacaaaaactcctgtcagacctgtcctatgaacagcatgaatacagcgctgaggagcggaaacttttaattctatgttcactattagagtcgcaagagccgatcaagctctacagtctggcgaacgaattgcaagtgacaaacgcgacaatcagttatgatctggatgagctggagacctggatcgcgcccttcggcttgacgctgatccgaaaaaggggcttcggcatacagctgacgggtccggaaaatgcgaaacggaaaatcgtcggcaatctcatcgtcaaccggcttgatattcagagctttttggaagcggttgaattcaatattaaaggaaaacctgacgatgctgaaaaaatgttcggggtcgtaaataaagcggaacttttgaaaatggaccggctcttgattcagctcaaggaaaaaatcgcgatcgccttatctgacagctcatacatggcgcttgcggttcatttaacctttgcgatggaccgaatcagactcggagaaaccatcacgatggaggcttcggaactaaaagcgctgcagcagacgaaggagtacggctctgcgatggaaatggcaaaagagcttgaaaaagcgtttggcgtttcaattccggaagctgagatcggttatatcaccattcatttgcggagcgccaaccgccaatacaaaacggaattcaaaccggaaaacattgaagttgaaacggccttgcaaacgaagcagctgatcggcttcatttctgaaaaaatcaaaattgatctgacggaaaacggttctttatacgacggtttaatcgcccatctggagcctgcgatcaaccgggtgaaagaaaatatcgacatgtacaacccgatgaccgagcaaattaaacgcgactactttctgctgtacatggccgtagaagaaggaatggaaaaattctttccggggcttcttttctctgatgatgagatcgctttcatcgttcttcacttcggctccgctctggaaatcaaacgggaagaagcgaagatcaaagcgctgatcgtctgttccagcggcatcgggtcgtccaaaatgctcgcatccagactgaaaaaggagcttccggaaatccgttcctttgatatgtcttccctcatcgaactgaaggaccgagacatcaccgcgtatgacatgatcgtatccaccgttccgatcccgtatggaaacattgattacgtcatggtcagtccgcttttaaacgaagaagacgctgatcaggtgaagcagtacatcaaaagaaaaattccgctgattcttgacaaaaaaagaaacggtaaaagagaagagaagcagccggagacgcctgatatgctggaagcggccggccgtatggcacattatgcggcggttatccaaagcgtgctgcggaacttttcgatcaaatccattgagtcaaacacggcgtacgaactgtttttgaatcgtttgtttgccatgcttgagcaagaaggatttgtccgtaatgccaaacaaaccgcacagcgccttgcagagcgtgaacgacagggcggactcggcattccgggaacggcgatggcgctgtaccatctcaaaaatgaagaaattgtcacgccttttttcaaaatttatgatttgacagctccatgcagtgtcaaaggcatggacggaaattccctgaccgtcggccgcgctttggtgatgatggcgccggctgatatgcccgctgaagggtcggaaatactaagtgcggtcagctccgccatcatcgagtccgaagacagtataaaagccttccagacggaggatgaagccgatttatacaaacgtttaaacaagctgttttatcatttcattcaggagaaaggacagcggtaaacagaaagcgcacacctcatatggggtgtgtttttttctgcatgtatgagggtaaggggaagggaagaaactaaaaacatgggactattgtatcattcacgaatggaatagttctaaaacaaaattgttttacaagttatattttttggtttaaaatgggttgcgtgaggaagaaaatctgacagagttttttgtgatttatgattatgggagatgaaaatatggagacattacagcatatgattctgcatgacatttcaaatagcgaagagatcgaagctgtaaaaagcggtgcgcataccctgacctacgcggaatatcgaaaacgaatcaaccagcttgcacaagcgcttcttgataaaggaataaaaaaaggcgacagagtggcgatgctttgcaaaaacggccacgcgtcatccattgtcatgtttgcggcactcgaaatcggcgcggttgttgtgccggtcagctggcaattaacaccttacgaaatgaaaggcattttagcagcctgtgaaccgaaagctgtctttttcggcactgaatttaaagagattatggaagaagttcttcctgcgctggtatcttctcttaaactgaagatcgagacaggaacagctgcggagacaacgcctgagtttgacgctttattgacaggctccggtgatacaccggatgtcgaaacggtgtctgaaaacgatacggcattgctgatgtttacctcaggtacaaccggcaatccgaaacgctgcatgatcactcacggcggcatatacaactacgtaaacgcgacattggcttacacggggagaatgcagcatgtccgcttcttagcatgccatccgaattaccatacgagcgcgattatctgccagatggtcggcacgatgagcggaacgacattcattatgacagacaatcaggaccctgtggaaaacttgaagctcatcgaaaaagaaaaaattcaaaccatcatggcgctgccagtctatttcacatacctgctgaaagcatgggaaacgcaccagactgacatgtcttctatcgtttatatgatgacgggaggcacaaaggtgccaagcagcctgatccagcagtatctcgacatcggcatcccgctcatgcacggatacggaagcacggaagcgtggggcatcagctcttggaatccgcaaatgggaatggataaagccgcttccgcgggtaaaccgatggaagaagtggacgtccgcgttgtagatccggaaacaggtgaagtccttccgcaaggctcaattggagaagtcgttgtgacaagtccgtttttattcaaaggctacgaaggtaacgaagaagcgacacgaaaagtgctgaaagacggctggttccataccggcgattccggctatgtggatgaagacggatttatctttatcaccggacgttataaagatgtcatcatctacggcggcgataatatttatcctgaccagattgaagaagtcattcagcaagtgccgggaattctcgaaacggcggttgtcggtatccctgatccgctctacggcgaaaagccgaaagcgttcatcgtgacaaacggcagagaagacctgacagaagaagaagtgacccgattccttcaagaacgtcttgctgcctttaaaattccggacattgagttcgtcagcgaacttccgaaaaacaaccttggaaaagtgagaaaagacgtgctccgcaaacaagcggtacgttcataatagagaacaaaaacccggctgccagccgggtttttttcttgcgttccatgtgaaacatttttctccgaaaacgttttgaactgtctcaatcatgtttatccggaagacagcagaggtagacaagaaatatgacaacgaaccagaaggaggaacttgacatggaaaactatccgaaggaattcccggcggaatcacaaaaccgccagccgggcattgaaagcgaaatgaatccggcgcctgtttacgaatacaaagaatataaaggcgctgacaaattaaaagggaaaaccgcgctcatcacagggggcgacagcggtatcggacgcgccgttgcggttgcttacgcgaaggaaggcgcaaatgtcgcgatcgtctattttgatgaacacgatgatgcggaagatacaaaaaaacgagtggaagaagaaggcgtaaaatgtctgttaatccccggcgatgtcggtgaggaagacttttgcaatgaagccgttgaaaaaacggttgaagaattcgggcgtcttgatattctcgtgaataacgccgcggaacagcatccgaaagaaagcattaaagacatcacaagcgagcagcttcacagaacctttaagacaaacttttactcacaattttatttgactaaaaaagcgattgattacatgaagccgggcagcgcgatcatcaatacgacatccattaatccttacacaggcaacccgcagctgattgactacacggctacgaaaggcgcgattaacggttttacgagatccatggcgcaagcgctcgtcaacgatggtatccgtgtcaacgccgtggcgccggggccgatctggacaccgcttattccggcgacattctcagaagaaacagtcgcttccttcggtcaggatacgccgatgggccgggcaggccagcctgttgagcatgtcggctgctatgtgctcttggcctcagacgaatcctcttatatgaccggacagacgctgcatgtcaacggcggcagatttgtgaccacataaggaggctgaccgatgacgatatcgaaacatgacgtgaatgcatactatcaaaaagcgggaatcgttctgactgatgatgaagtcgaagacattcaaatcatggattacggcttaggcaagcttgaggaaaccgggcttcagctgtttatttacgtgaataccgaccgctactgttcgaaagaattggtgctcttcccgcgccagacgtgtccggaacaccgccatccgccggtcggcggcgagaagggaaaacaagagacattccgatgccgctgggggaaggtgtatctctacgtggaaggcgaaaagacagagaacccaagcgtcctcccgccggaagaagacaaggaatactacaccgtctggcatgagattgtgcttgagccgggcggacaatacaccattccgccggatacgaagcattggtttcaagcgggagaagaaggggcggtcgttacggaaatgtcatcgacaagcacggatgatcacgatgttttcaccgacccgcgcatttaaggatgaggctgcacgcctcatcttttttgtatggaaaaaaataaatttacctgtataatggctaataaaggaaagaaggtgcggtcgtgttttcctgtcaaatccgggaacatctgacgatcagattgcttgccaaagaagatacggacgaattgtattctgttatgaagcgaaatcaaaaccatctcagcgaatggctcagctgggcggaagaactggctgacatcgatacgtaccgcgatgtgatcatccccgaatggcgctataaatatgcggaagagaatgggtttgacgccggaatttttgtgaagggccggttttgcggcatgatcagcatccataatgtcgatacagtcaatcaaaaagcagagatcggctactggctggatcgagagcatgaaggattcggcattatcaccgcaagctgccgggcggtcatcacccatgcatttcaggacctcgggctgaaccgcatcatgatcagcgcggctgaaaaaaacacgaaaagcagggcggtggcggaacggctcggatttcagaaagaaggactgacgagagaaggcatttttgtacagggcgcctatcatgacacggtgaactacagcatgctgaagcgggaatggagcgaagatcggcagaagagcacatttcttggtttaaatgtctccccaatgtggaaaagtaacagcggagacgttaaaaaggagtgattcttcatgaatcaaaatgaaatcaaagaaaaagtgcttgaagtactggatcatcataaagtcggttcgcttgcgacggtagagcaaggcaaaccgcattcacgctacatgacatttttccatgacggcttaacgatttacacgccgacgagcaaagacactcataaagcggaagaaattgaaaacaatccgaatgttcatattctgttagggtatgactgtgaaggattcggtgacgcttatgtggaagtggccggaaccgccaaactgaacaactcagcagatttaaaagaaaagctgtgggatccgaaactggaacgctggtttgacggaaaagacgatccgaacctggtgattctcgaaattgaaccgaagcagatcaagctcatgaatgcgggtgaaaaaacgccggccgagctggaactttaataaatcatttgattattcaggggcaatctgttatacttaactgctaagtgacaacatgcaaataaaaaagaaagtaaacttcttttttctgttttgatatagaagcttcaggcttcaacggacagcttgaaaaaaagctgagcttattcttttccttctgatattcgcccctaacgaagagatggaaaaaagactttttgttttacaattcacaccggcgcggcttcggagccgcagtgacgattgagaggtagggctttcgttgtcttgtgttcaagaacttccatggtgtttactttcgaagaatgattctgtcggaactgttaatacgaatcacccgcaggctaaggcgggcaaccatatattatttatttgcgtaagaaaagaataagacaaaaccgcgccggacatccgggcggtttttttatgtaaacggccgaaaccttgccgcagtctgcagagtctaatcagtatgaaaagatttggaggaatcatacattgcacgttattacttcacaagtactgtttatcttctgttttctgctgctgatacattcgattgaaacgcttgcctatgcaacacggctttccggcgcgagagtcggatttatcgcgtccgcgctgtcattatttaatgtcatggttattgtgtcgcgcatgtcaaacatggttcagcagccgtttaccggacatctgattgatgccgccggatcaaacgctctgtctgttgtgggcgctcagtttcgatttttaatattcggctccacggtcggaacgatgctcggcatctgtcttttgccgacattcgtcgcgttattctccagggcgattatacacttggcggacggaggaggctccgtcatgcaggtatttaaaaaaggattttcactgaacgggctgaagcatgcgcgttcttatatcagactgccgtcagtctcctatttaaaggggcttcaattccgaatgattccgaaacgcttgtttgtcattaatatggtcattacgtctatttacacgatcggtgttctgtccgctctgtacgccggccttctggcgcctgagcacagcacgacggccgttatggcatcaggcttaatcaacggcgttgcgactatgctgctggccgtgtttgttgacccgaaagtctccgtactggcagacgatgtggcgaagggcaagcgcagctacgtctccttaaaatggacctcattgacgatggtcacatcaagggtcgcgggcacgcttctcgcccagctcgtattcatccccggcgcttattatatcgcctgggtgacgaaatggatgtaacgcatgaaaaaagctcctctgcagaagaggagcttttttattgataatttctcaggccgcgatcataaataaaattaccgaacggaataaaggccgcgataaaaccggcggctgaccatttcacatgccatttgacagtaaacgccgcatacgccagcaccgccagataaatgataaacaaaccgccgtgaatggaaccggcaatggtgacggcgagcggatgatgagcccaatacttcagcggcatcgcgataaacagcagcaccaaaagcgacattccttcaataaaccccatcgtgcgaagtctgccgatcggcgtgtgtaacatacagctccctcctgtcggacatcttttttcctctatactataagcaaagggcagtcctaatatgaccatttcgcgtcagttcctgaaaaaaccttcatgatttcagcctgttgttcttgtcatttttcggatttctcttgataatatagccaaaagggtaaggaaggactacagtcatgaaactagataatgtggatctgagcatcattaaagagctgcagcgggacagccgcctgtccatgcgggagctgggcagaaaaatcaaattgtcagccccgtccgtcacagagcgtgtcagacagcttgaatccttcggcgttattaagcgctatacattggacattgatcaaaaaaagatcgggctccccgtctcctgcattgtcgaagcgacggtgaaaaacggaaaatacgatcaattcaaaacctacattcaatccattcccaacattgaattttgttttcgggtcgccggggcggcgtgttatatgctgaagattaacgcggacagtctggaaacgatcgaacacttcatcaaccgcacctctccgtatgcccaaaccgtgacccacgtcattttctcagaaattgacacaaaaaacgtcctcgattagagagagcgtgaggaagtctgttataataacaggatgagtgtgaaagaaagagaagtgaaaagcatgtcaaaaacagttgtattagctgaaaaaccttcagtcggccgggacttggcccgtgttctgaagtgtcataaaaaaggaaacggatatcttgaaggcgaccgctacatcgtcacatgggcgctcgggcatctggtaacgctcgctgaccccgaaggatacggcaaagaatttcaatcatggcggcttgaggatcttccgattattccggagcctttaaagctcgtcgtcattaaaaaaacaggaaaacagttcaatgcggtcaaagctcagcttgtccggaaagacgtcagccagatcgtaatcgctacagacgcaggacgggaaggggaacttgtggcccgctggattatcgaaaaggcaaacgtccgcaaaccgattaagcggctgtggatttcctctgtgacggataaggcgattaaagaaggatttcaaaagctccgcagcggcaaagagtacgaaaacctgtatcattccgctgttgccagagcggaagcggattggatcgtcggcatcaacgcgacccgcgccctgaccacgaaatttaacgcgcagctgtcatgcggacgcgtccagactccgacactggcgatgatcgccaaacgcgaagcggatattcaggcgttcaaacccgttccttattacggcctccgcgcggcggctgatcagatgacgctgacatggcaggataaaaaaacaaaacagacaagaacgttcgatcagacggtgaccggccgtttggcaaaagacctgcaaggaaagccggcagtcatttcagaattgaaaaaaacggcgaaaaaaagcttcgctcccggtctttacgacttgacggaattgcagcgggacgctcataagcgcttcggtttctccgcaaaagagacgctgtccgtgcttcaaaagctgtatgaacagcataagcttgtcacttacccgcggacggattccagattcctttccgcagacatcgtgccgactttaaaagaccgtttaaacggcatggaagttaagccgtacgcccagtacgtcaatcaaatactgaagcggggcgtcaaagcgcataaaggattcgtcaatgatgcgaaagtatcggatcaccatgccatcattccgacagaggagccgctgatcctttcaagcctcagcgacaaagaacgaaagctttacgatctgattgccaaacgttttctcgccgtgttaatgccggcgttcgaatacgaagaaacaaaggtcacagccgatatcggcggcgaaacatttaccgcaaaagggaaaacggttcaatcgcctggctggaaagccgtgtatgatatgtacgaggatgacgacgatcatgaggaagacaaagaccagacgctcccggatcttcagcaggggcagcgcctcactgtctcatcattgaaagaaacgagcggtcagacgaaaccgccggcgcgctttaatgaaggcacgctgttatccgcgatggagaacccaagcgcctttatgcagggagaagagaagaaccttgtgaaaacattgggtgaaaccggcggactcggaacagtcgccacccgcgctgatatcattgaaaaactgttcaacagtttcttgatcgagaaaaaagaaaaagatattttcattacgtcaaaagggaagcagctcttacagctcgtcccggaagatttgaaatcgccggccttaaccgctgaatgggagcaaaagctctccgccatcgcagcgggcaaactgaaatccgccgtgttcattaaagacatgaaaacatatgcgggcaaaacggtgaaggagatcaaaaacagcagccagactttcagacatgacaacatttcaggcaccgcctgccctgattgcggcaaaatgatgcttaaagtcaacggcaaacgcggcacgatgctcgtatgtcaggatcgtgagtgcggcagccggaaaacgctggcaagaaaaacaaacgcccgctgtccgaactgtcataagaaaatggagcttcgcggccagggcgaaggccaaaccttcgcatgtgtatgcggccaccgggagaaactgtccgtctttgaaaagcggaaggcgaaagataaatccggacgcgcatccaagcgggacattaactcttatatgaaaagccaaaacaaagaggagccgatgaacaacgcgctggcagaacagctgaaaaaactcggcctggataaatagatcagagaaaggcagcatttgtaaagaaatgctgccttttgttgtgttttttactgtaatgggaatacgatccatgtgaagagggaaaaggtgagaggcggcgcttccatttaaaattttccaatgtgaaaaaatgctagtattcttttatcgtttcctttatagtaaaaatactttgtgaaaaaataagatatgggtctaaaaaaggatttgtaaaataggaggatggactgtgaagcaattcgtttttcgtctgatgatccttttgatttcaatcgttctgacggcggggtgcgcggaggccggacctgaaaaacagacggcggccgaaccgtccggaccgcttcagcccgcagagcattttatttatcataaattgatgaacgggcgggggatgatccggacgaacatatccggtgagccggaatatttatctgagtctctcggactatggatggcatttttgctgaacaggaaagatgaacggcagtttcaagcgcaatatcagcttctcaccgattcgtttctgacgaaaaacgggctcgtgtcgtggaagattgacgggaataaagcgagcggcaccaatgccttaattgacgatttcagaatcatgaactgtctgaatgaggccggaaccctgtggggaaacagtgaatacgggaaaacagcggtgcagatcgggaaggcgctggaaaaatacaatacaaatgacgggtattttacggattattatgatgccgcttcaaatgccgcatcaaagaccgtgaccttgtcctatgttgaccccggcgccttacagatgctcagagaaaaagggattatcgatgagaaaacggaaaaccggaaccttgatgttctcaatcgagctcccctgaaaaatggttttctgccgaaatcattcaataccgaaacaaaggaatacaaatatgacagcgaagtgaatgtcatcgaccagctgtacgccgccgtgaatctgaagcggggcgatggcaaggctgccgcgctgtcaaaatggatgatagaggaatttaagtcgcgcggacagctgtacggacgatacagcgcagacacgaaggagccggcggttcagtacgaatcaccgtccgtttacgccctggccgttctttttttagcagaacaaaaagctgatccggctgtcatcaagccgctttatgaaagaatgacttcatttgaaacactggacacgctgaaacccgattacggcggctatatgagcgggagcgatacacattctttcgataacctgctgccgcttctggctgaaaggaaattgtttaatgaaaatatcattcaatgaatcacaaaaactgtgcagctacacagcagttatgctggtgctgctgtctttttttatttactatgcgtctcagcaatccgcagggcttctgataacctgcatcacattgcttgttgcgggagccggtatatggttcggggcaatctacgcgctcgtcatgaccttactcgtcttatttgttctcggcagcctgctcctgtggtttcagaccgggagctttatggcgtctgccgatgccgaaagtctgcaggtgctggtcatttgggggattgcgctgctgctcttttcttacatagcgggaaggattcacgagttggcgaaggggcttgaacgctcagtgaaacagctgcgtgaagagattacgagctttgtcgccgtcgacagggtgaccggctttgacaaccatctgcggatgaagctggagctttccgaggaaatcaagcgggcggaacgctacggcaattccttcgtctttttgctgctgcacatgcattatttcaaggaattcaaatccctatacggagaaaaagagaccgatcggctgctggcgtttatcagccgccaaatccggtcaagcgttcgggaaacagacaaaaaattcaggccgtccgccgaacggttcggcatcgtgctgacccatacgcctgaagaaaacatgccggccgttctggcgaagctgaaaaaggaattggatacgtaccggctgcaaaacggtaaatacgtctccatcaccttccgtgtatgttacttggcgtaccgaaaggatttacaaacggccgagcaatttttaaatgaactggaaaacgagatgatgatgaatgaactctaaatggatacgtctcttactctcggcgcttttcatgatttcggcggtttatgttccccgtccggcggaagcaaaagacaaaaaggacggcattctcattatttatacaagcacggacggcaaagaaaccgctgaggtcaaaatgcttgatctgaccgcgggccatttctcatccgccgtcaccgtgaaaagcgacggagacatcacagccgcggacttcaaaaagaatcggcgcgtcatctattacggcgtcacgaaaaaaaagctcagcacatcatttgtgtcactgatcagcagcatgccgcagcagcttatcagcatcggctataacgccggacagttccgccaatttgcggggttgtccctgacagaaaaagaaacggtataccgcatttacggcaaaaaagaaaaaacagacatgccgcttgaaaagggggtgtccgtgctcggcgtatcgggagtaaaaggaaagtccctttatacataccggtccggtgacggcagcacccgcccttttatgtggaaaacggcgcgctctgactattatttcggtgtgacgagcctgttaaatgattcgtttctgacggcgaaagcgatgcgcagcgcattcggagaatcagagggcggcaccctcctttatttgcggcttgaagacatcagtccgatgtcagatgaaagattgctttacgaagcgggcgcttacctgcataaaagacacattccgtttattctggcggtcattccggtctatctcaatccggaaaacggagaaaaagtatacctggcggacaagccaaaaatggtcagcgtcctgaaaaaacttcagcaaatgggcggtagcatcattattcacggctacacgcacgcataccgatacagcgaaacgggagaaggctttgaattttgggatgccaaagcggatcagccgattacgtcagaaaatgcggatgatactccggtcaagcttgaaaaggaacaggattttccgaatgaaaaagcgtaccgggcgtatgtgaagcctttccgtgaaaaagaaaacatctacacgagaacgaagctggagcaggcgattgacgatctgacagagctcggcctttacccgctgtcattcgaagcgccgcactacacgatgtctgaagaaggctacaaaatcgcatcttcttatttctccagcattttcggacaagtgcagctcagcggcgcgacgtggaaaacctcgggcgcccctccgttcgtctcaaagccggctatgctggacgggatgacgctgtaccctgaaacaatcggttatgccgataactcaaaggaaaatccgctcggagatatggagaatcatatttctcagatgattgatttcggcggcggaacggcgggcggtttctaccatccgtatctcggcatgaaataccttcccgagctcgtcaatcagatggagcggattcccggcggcgagtggctcgatctgaagaaaacgaagcaaacggtaacgtcggacagcgtcaggatcaaaacggacggagacggaaccattcatgtggaaaacaagattcatccggtaacggcctttttcaatcatcaccagcagacgcctcttgaaaaagcgctttggattctctccggcgtggtgttattgtttatcatcatgttcgcctgctacgtcctttatttgcgcgccacattaaaaaaacgaatctttaaggagagaagaagccttgagtaacattctgttttttatctcattaagtttaatatgggtgatgcttctctatcacatgtttctgatgcagggcggattcaggcattatatgaccttcgaacggaacattccgaaatggcgcgcaaagatgggggagctcccgaaggtcagcgtgctcatccccgcgcataacgaggaggtcgtcatcaggcagacgctgaaggcgatggtgaacctgtattatccgaaagacaggcttgagatcattgtcgttaatgataattcctccgaccggacgggagacatcgtcaatgaattttcccgtcagtatgacttcattaaaatggtcatcacaaagcccccgaacgccggaaaaggaaaatcttcggcgctgaactcagggttcgcggaatcgaacggagacgtgatctgcgtgtatgatgcggacaatacgccggaaaaaatggcggtgtactacctggttctcggtctgatgaatgatgagaaagcgggagcggttgtcgggaaattccgtgttatcaatgcggcgaaaacgatcctgacgaagtttatcaatattgaaaccatctgttttcagtggatggcgcagggcggcagatggaaatggttcaaaatcgccaccatcccgggaacgaacttcgcgatcaggcggagcattatcgaacagctcggcggctgggatgataaggcgctggcggaggataccgagctgaccatccgcgtgtataatctcggctatcatatccgctttttcccggcggctgtgacatgggagcaggagcctgagacatggaaggtctggtggcgtcagcggacaagatgggcgcgcggcaaccagtacgtcgttcttaagtttttatcccaatttttcaagctgaaacgcaagcggatcatcttcgatctgttttatttcttttttacgtattttttgtttttcttcggtgtgatcatgtcaaacacgatttttatcatcaatcttttttacgacctgcatctgacagtcgggtttttggcgatgattttgtggatactggcctttttcctgtttatgactgaggtcatgattactttaagcattgaaaaaacagaaatgaacaaacaaaacttctttatcgtatttctgatgtactttacatactctcaggcttggatcgtgctcgtcatctggtcattattcacagagatcaagcaccgattgttcaagcaggaagtcaagtggtacaaaacggagcgatacaatcaaaataaaagcgggtgacctttttgaaaaaagcgatattgataactggccttttgctattgatgtataacgggcaggcggccgcggcccgggagctgaaaacggacggttccgctctcggaacaagcgccggcgcaaaagagcagcaggcgctgactggcgatctgatgacactgtacggggcgaaagacagctcagagctgacctatcagattcctgcgggagcttcgaatgccgatcagtcgcttctgattgattacgaggcgtcaaacttattaattgccccgtcttctttaaccatcgccattgatgatgaacccgtcaaatccataaagcttgacggcagctccaagcggaaaacggtgaagctcaatctcagcaaaagccaatccgcccaaggctatcacaatgtatcattacgattttacggcgtattaaaagagggcgtctgcgtcaggcaggatacgtcaggcaactggataaaaatttatccggacagccgccttgtgctttcagaagcaagcaagtcaaagggagcggatctcggccatttcccgtatccgtttgcccaatcaggcaatacgggtgaagaaaccgatattatccttcctgacaaaccgacctcggcggaagctgaagccgcagtcaaaacagaaggatttctgaaaacggcagacagcaggctgaaggtatcctatgtaaaagaatccgatgccggcaaaatcagcaatccgtcaattgtcatcggcgctgatcagcattggaacgggaaaataaaagagcttttcgaacgggggaacttcaaagcggaagacaacaaactccttctcgccgaacgggttctgacatcaggggacaaacggcagcccgtcctgtttgtcacggcgcactcagacaaaacgctggcggataaaatccgcgtcatcacagacagcgcttattcaagccagctgggcggagatactttgacaatcggccgccttcagcccgctgcggaaaagacaggcaataaactgacattagaggacttcggcgcgggaaatgtaacggtcggatcaaacaaaacggcgtcagagcacttcttttaccctgcggcggccgctgttgataaagacggtaaggtcaagctttcacttacattaaagacgtcggaatcgatccggacgaaggcggattcagctaatgacgccgagagagcggagctgaacgtcatgatcaacggacagccgaatgcggtgcgccttgatgatctcggcaatcaagataaagatggcttttaccacgtctcaatcccgattgatccgaagcttttgcgaagcagcaggtacattgatctgcaatttgtcacatcaggtttgaaacataacaacccgtgtattgaccgtgacgaaaataaatgggtctatattgataaaagcagcatgctgacgtatccggtaagtgatgcggcgcagaaagcggatttcgggcaatggccgctcccgtttgcgggcggcgtgaaagagaaaacagtgatcgtcatcccggatgacgtaaacatacagacactgaaagaactttctctggtggcggattcattcggaaacggctttaccgtaaagacggcatcagacatgaaggaagcggatgccaaaggccggaatgttgtgtttatcggaggcctgccgcaaattccgcttttgaaatcaaacgcctctaagcttctcgtgccgtcagaccgcagcggcgcgtacgatgtttcttcgtttcagatgctgaatgagacaacgaaacaagtcgcgtttacccaggaatcaccttgggactccggccgaagcatcgctgtttttgctccgttatcaggcagcggcgcgtctgtcacaaaagagctgatcagctttttagacagcacaagcgatgccgcaaccgtcgtcaacgaaacggccggcaagcagctgttttcaaaccatcagcaaatcaaatccgacgacagcagtccggcgcctgatacgaaaagccgttccgcagcactgaacgtcacgtatatcgctgttttcgcggcgcttataattattgcggccggtctgatctggctgacggcaagaaggaaaaaagaaaagcggataatgaaaaaagtgaagagtaatgaaggaaaaagaggccgttaacaggcctctttttttgtatttttatttccatttttggcggtgatttttttatttttgaaacagcataaaagcccctttacaactgaacgggacgggagtatgatctcttttataatctatatcgcttaatctgtaatcagagcgggggaaccaatttgcggcgcgtcatgccgcttggggtgaatcctttttcaggtagggccaactctcatcagcccgaatccgacagctaacctcgtaagcgttcatgagaggagatgaatgaaacctgtgcacgattatggcgcaggggcatccgtttgcctctgtgtctttttgctgtgccgaaatatggcatgcaatcgttattcagagacatcatagcagtaagggtttgtaaatcaaacggaaaatgaaaaaaaggggaagacaaaaaatgtaccattcaatcaaaagatttttgattgggaaaccgctgaaatcacaggcggccggagagcagaaactcacgaaactcaaggcgctcgccatgctttcttcagacgcgctgtcatcagttgcttacggaacggaacagattctgatcattttggctgcggtaagcgcggccgcgttttggtattccattccgatcgcagcgggtgttctcattttgctgcttgctttgattctgtcctacagacagattatttacgcttatccgcaaggcggaggcgcttatatggtttctaaagaaaatcttggtgagaagcccggcctgattgcgggcggctcattgcttgttgattatattctgacggtggcggtaagcatttctgccggaactgacgcgattacatcggcatttccggccctgcacccgtatcatttgctcattgctgttttgcttgtgattctgattatgattttaaatttgagagggctgtcagaatcggcgtccattttggcgtatcccgtctatctgtttgtggcggcgcttgtccttttgatcgtcgtcggtctgtttaagctcatgacgggccaggttcatccggccgagcatacaccgatcggcacgcccgtagcgggcatcacgctgtttttgctgctgaaggccttttcatccggctgctcggcactgaccggtgtggaagccatttcaaacgcgatcccggcctttaaaaatcctccggcgaaaaacgcggcccgcactttggccatgatggggattctgctggcgatcttatttacggggattacggtgctggcgtacggctacggcacgggtccgaagcctaacgagaccgttatttcacaaatcgccgcggaaaccttcggacgccatacggtgtactatttcattcaaggcgtgacatccctgattcttgtgcttgcggcaaatacgggcttttccgcttttccgcagctggcgtttaatttagcgcgcgatcagtatatgccgagaatgtttacggtacgaggcgaccgattaggattttcaaacggaatcatctttctcggtatcgcgtccatcctgctcattcttttattcggcggccgcacggaacatttaattccgctttatgccgtcggcgtgttcattccgtttacgctgtcgcagacgggaatgtgcatcaagtggatcaggcagaagccgaagggctgggcggtaaaaatgctgatcaactcatgcggcgccgccatttcatttatggtgctgtgtattttattcgcgacgaagttcaatcttgtctggccggtgctgttattcatgcctgctgtcgtcatgctgtttttcgtcattaaaaatcactacaccgcggtcggcgaacagctgcgggtcgttgatcagcagcctgaggaaatcaagggaaccgtcgtcatcgtgcctgtcgccggtgtcaccaccgtcgtccaaaaatcgattcagtatgcgaaatcattatcggatcaggtcattgcggttcatgtttcctttgacagagaacacgaaaaaaaggtggaaaagcgctgggaagagcttcataacggcgtccgcctcgtcaccctgcattcctcataccgcagtctggttcacccgtttgataagtttttggaaacggtcgaacaaaaagcgaaaaaagaacagttctccgtgatggtgctgtttccgcaatttattacgaaaaaacgctggcagaccatccttcacaaccaatcagccttcttgctccgcgtccggctgttttggaagaaggacatcatcgtcgccaccctgccgtatcattttaaaaagtaacggaaagaccgcaggctgaaatgccgcggtcttttttgtaaaggaggacgacatggcacaaggcgcttttgtcatcatacaaaatgatgggcgggacatattgctcgtaaaacgaaaagacgttccactatgggatttgcccggggcgggattgaagaaggtgaaacatctgaagccgcagccgtcagagaggcctttgaagaaacagggtataacgtgaccatcctgcaaaaatccggtgagtatgaaaggccggcatttgaagatacacagcacgttttcatcggagccattaccggaggaacaccgctgatgaacggatcggaaaccgccgatttacgctggttttcccaaaaccggctgccgctgttcatggtgccgaacagaaaacggcaaataaaagacggactcaatggggcggcaaatcgtaaggcagtccttaaagaccgaaatctgttatccatccttgatctgctgagaaaaaagctgagagtatagcccgtgtttcaacccgtatgaaaaaggggatgaatacaggtaaaaggaggatgcagtatgccaagtaaaacagcaggacacgtaatgacggagctgcttgaacaatggggagtcggtcatatatacggcattcccggagacagcattaatgaatttatcgaagaactgagacatgaacgaaataacctgacattcatccaaacccggcacgaagaagtcgcagccctggctgccgcggctgaggcaaaactgaccgggcagatcggtgtctgcctttcaatcgcaggaccgggggccgttcatctgctgaacggtttatacgacgccaaagcggacggcgttccggtgctggcgattgcgggacaggtggcttccgatgaaatcggccgtgacagctttcaggaaatcaaattagagcagatgtttgaggacgtggcggtattcaaccagcaggtacatacggcagaagcgctgcccgatcttctgaatcaggcgatccgcacggcttacagcaaaaaaggcgttgccgttttaaccgtttctgatgatttattcgcgcaaaaaatcaaacgggagccggtttacacatcgccgatatacctcaaagccgatatagagccgaaaaaagaacatctcgtcacatgcgcgcaatatattaacaacgcaaaaaaaccggtcattcttgccggccaagggttaaaatcggcaaaagaggagctgctcgcattcgccgataaagcggccgctccgattgtgattactcttccggcaaaaggcgtcgtgcctgacagccatccccactttctcgggaatctcgggcaaatcggcacaaagcccgcctacgaagccatggaggaatgcgatctgctgatcatgctcggcacatcgttcccgtacagggattatctcccggatgatacgcccgccattcagcttgattcggatccggcgaaaatcggcaagcgctatcccgtcaatgcgggaatcgtcagtgatgcggctctggggctgaaagagctgacggaatacattgaatataaagaagacagaagatttttggacgcctgcaccgagcacatgaagcattggtggaaggaaatcgaaaaggatgaaaccgaagcgactcatccgctcaagccgcagcaggtcattgcccggcttcaggatgcggccgcagaggacgccgtcctgtcagtggatgtcggaacggttacagtgtggatggcccgccattttaaaatgaagaagcaggactttatcgtctcaagctggctcgccacaatgggatgcgggcttccgggagcgattgccgcaagccttgccgaacctgatcggcagtccatcgccatttgcggagacggcggattttcaatggtgatgcaggatctgccgacggctgttaaatataaactgccgattacggttgtcatattaaacaacgaaaatttaggcatgattgaatatgaacagcgggtcaaaggcaacattgactacgtcacccagctgcaaaatatggattacgccgcctttgcagaaagctgcggggcaaaaggcatcaaagtgacgaaacacgaggaattggctcccgcttttcatgaagcgctcaactcaaatgagccggtcgtcatcgacgccgtcatcggcgacgagccgccgcttccgggaaaaatcacttacggccaagcgaagggcttcagcaaatacatgctgaaaaacttctttgaaaaccaaaaaatcgaaatgccgtcactcaagaaaagcttaaaacggctgttttaagaagccggtggttataaaaaaattaacaggcagcatgcctgttaatttttttaggctttcttattgatgattatttctttactgacccccttccatggtaaggaagtggtcagcagtttgacccgcttggaagcttagaggacgggaaccgtaaccgaaagtatatcgtattaaaatctgcggaaacggtaaagaaaatcgtaaaatctgcagctagcaagcgatggctgataaaaaagcttttggagggccaggacagttcataacaaacgtggttcgctcattagcatcgcacagcccttatcagcaaaaacaggaacaaagactggcgtggcgacgtacaccgtcaagaagggagatgtcctccctgtaattgcacagaaaactgccgtaaacatggccaccatccagagattgaacagtatcaagggcccgaattttatcaaagtcggccaagtattaaagctgacggactcggccagctctccaacaaaaggcaaaaaatcatcttacacgctgccatcgggcgtttttaaagtgacaagccccttaactaagggaacggccgtgaaacagatccagacagctttggcggctctctattattatccggacaaaggggcaaagaacaacggaatagatggctattacggaccgaagacagcaaatgcagtcaaacggttccagtccatgtatggactgcctgctgacggcatttacgggccgaaaacgaaagcaaggcttggagaaatgttaaaaagggaataaaaaagcaggctctaaattgcctgcttttctttttattagcctaatttctcttttgagatcttatccaaattagtaaaaagtatatccaggcccgaaaataagaaagttatgaagaatgaaagaagaatttctccaccttgaaatatagatatgttttcaatgaaattactggaaacatatttaattgagaagtaaacagcagcccatgcaaaaatgaattcaagtatataggctaaccaagcaggtaatttaaaaatatgagtaattccttttacaattgccataaggattagcatataaattaaagctaaaatacttacgacaacagaaaatatgtataagtctgaaagtgaaccatagatgatatactctccgaaaaaatgatttacagttatagctacaaaataaatacctaggctaggtacagttatagcgaagaacagggagaatccaataagccctatgaatgctatatgagctaagtggttgggtggtgtatccacaatctccttttttaatagaatcataaaaataagagatgaaataacaagacagcatagtatggtgagcaatacggtaataaagatagccatgttaacctccaatgaaaaagtgctattagagtgaatctaacagcactttaaattttaaatatgttaaatcaaagcaacaatgaatttagctaaagtggtagctacatctgtaggagctccgatagctttaaaagcttttgtaaattgttttacaccccaattttcacctttatccataatgtcggcaaccttcttagagttttttctaatccatgccgcagctttaggggagaatggctttaaggcttttgataaaagccatccacctgaacggcaggcagctctgaaagccttataggaccacgaaactacaccttgggtttggtagtcaccattgagagccgctttggttggaatagtgccaggcattccagttggaatagtacctggtgcagttttcgttaccggtacaggagttgtggttctgttttcagctgctaaagcacctgaagtacccaagaatgatgtaagtagagttgcgcttaaaactacagggattactttcttcttcatatatattttcctcctaataatttatgaataacaataaaatgtttcatcgctaacgttgtccaatgagcgaggcttttagccttgtcagaaagtccagactttttaagtgaaagataaagattctctccacgtcaatacaactcaaggcaacatattcgtttaatagcttctttaaaaccagtttaagctaaaaggaaaacggcttatcaattattataaaaaattggtttggtaattccagtggcattagtagtggtatctcggttttcttcagctcaggatgtggggacaaaagaagcagttacaagggctaaagatgtggcgaatagaataccgttagctacgtgtttaatgaaaaatcctcctttaggaatgtaatctgccagcgaaatgaaagactatgtatttaggatagtcctatattattctctttgaatatttttccacctccttcagaaaccattctatcaataggtattttttgggtaaatagtatttttatacagtatttttatgttgaggtataatttccctgtgtcttaaaacaagttaatcaggtgagtatgacgcaaaagtaaattgcggttttttttcgttttcactttatgttcaaatagttataatattacaaaaatagcaattagagggagaggtatatatggatcaagttttaccgtcgtcccaagttggtgtcaagatcaatgaatggtacaaaatgattcgccagttcagtgtgcctgatgctgagattttaaaggctgaggtcgaacaggaaatagaggagatggaagaggatcaggatttgcttgttttttattcattgatgtgctttcgtcaccaattgatgttagattccttggagccggaagacagatatcgagatcgccccacagtcgacgaactacttgaaaaaatagaaaagccgcaaaaaagacttacaggcctcttgaagtattactcattattttttcgtggaatgtatgaatttgatcataaagagtatgttgatgcgataagctattatcgcaaagcagagagagagttgaatgctgtatcagatgaaatggagcaagctgaatttcattacaaaatagctgatgcctattatcaaattgatcagcactttgtttccctcaatcatttaaaaaaagccaagcaattgtttgaaaaaaatcaattatacaaagtgaaagtgattggctgtaatatgatggtcggtgctaacatgtacgatatgtacaggctgacggaggcagaatcatattatcgggaagcattaagtaacgcccgtggcttggatgaggaaaaagtgaaaagaattatcggagtgatctttcataactcaggcttagtttatttaagagggaaaaatttgattgctgctgaagagaatttcaaaaaggcaatagacgtgaaagaacatattgatacagtgtatggagtgagatcattatatatgatggcgaatgtcctgtaccaatgtgataaagccaaggaagcacgtttcttttatgaaacggctttaaatcgtgctcggacttctaatgaagaggaatatttggctaaattaaaaatcattaattcattgtacgaagaatataatgaaacagaagtgaaacaaagcttaggttacttggaagagaaacgcctttggtctgatttcgcagagctaaccgaaaaattaggtgactttcattttgagaagagaaactatgcagagggaagaaactttttaaagaaaaccatacatgcccaaacacaaatacttaaggttacggaggctatataatgaagaaacttataatcagctccgctttaatcggtattctttttactggattattaagtgtgacaaatgtttatactgctgaaatgagtgactctggaactttttatatcgctgaaaaagctataaatatttaagtgttctccaatttttgacctccaccttttaagactgggggatttctttttcttatccagtaatcaacatacgctgcctcataaggttcttaaccgttacttgtattgcgttcacctttccgttttgctgtgaagtgttttcttgaacgatgcatgcatgagaaagacgccgtccatttttaagcctatcttcaatcattcaaggacaaacaaaagagctatcgagaagatctcgacagctcctttgtttgttgagcggcttgcttgcatatagtcgtcctaaacgaaaacgatgattgtgaaaatcggcagctggcgagcgatggctgatcaaaaaactcgtgatggatcagcgcggtttcatctgaagaacagccagagagcggtcacaacagcgatcataaagtaatctccatcattcagtttagttccatttttgacaaacacatgtgccgtccggttcgtctttgtccctttcggagttttaagcgcaatgttcttccctatattgtaataaacaactttaaacaaataatatgccagcgaacagaataaaaagagcaacatgaacttgccaataaacaatatcatgtttcattactcctttttgccgttttttcgtttgaatatatgacggaaaagtcaggatgttatataaaaggagaagtattttaccgaggctggtgttaaacattaatgaacggttcgccgcaacatccccagatccggaacaatttcaaaacgaaagagaagcccgaggattattaaaaacagaccctaatttgtccgcttttttttgaacatttgatccaagatgaacataaagagagtgaataagaaggacaccgtaatcatatctatcagaaatatattaggagtatcttttattaatagcagccataccacctgcaaaactaaagaaatagaaaaataagatatatatgtcatgatcctcatatttgttacccccttagcctaatttctcttttgtgatcttatccaaattagtaaaaaggatatccaatcccgaaaataagaaagtgatgaacaatgaaagaagaatttctccaccttgaaatatagatatgttctcaatgatatgattggaaacgtattggattgagaagtaaacagcagcccatgcaaaaatgaattcaaggatataggctgaccaagcaggtaatgtaaaaacatgagtcattccttttacaattgccgtaaggattagcatataaactaaagctaagatactgacgacgacagaaaatatgtataagtctgaaagtgaaccatagatgatatactctccgaaaaaatgatgtattgttacagctgcaaaacaaataatcaggctggggacagtcacagcgaagaacagggagaatccaataagtatgatgaatgctgcatgagctaagcggtttggcggtgtatccacgatctctttttttaatagaatcataaaaataagagatgaaatcacaaggcagcataagaaagtgagcaaaacagtaaaaaagacagtcatgtgacatctccaatgaaaaagtgctattagagtgaatctaacagcactttgcattactttatacgtattttcctgacgatcatttatgaatgattttaaaatgctttcattgctaaagttgtcaaatgagcgaggtttttagcctggctgtcagaaagtccggactttttaagtgaaagataaagattcttttccacgtcagtccagcttaaggcgacatactcgttcagcattttctttaaaaccggttcgatgtgttcattgaaaacggattcgagttcatttcttattttctttcctgctaatttttcaacaagattgaataattttgttttatttttcagcacttctctgattacatctttgactggttttgacacagatgcatcgctttgtgctttaagtccgtaggaaaattgcgtatcagtctgataaaaaaatgattttgtcgttccagtggcattggcagtattatgatgattttctttagctaaggatgcggggacaaaagcagtagttacaagggctaaagatgcggcaaacagaatgcctttagctgcgtgtctaatgggaaatcctcctttagaaatgtagtgtagagagaaatgaaagactatgtatttaggcgggacctgtatgatccgctttgaacatttttccctctcagataccattctatcaataggtattttttgggtaaataggattttaatacgatatttttctcgcaattcaaaatttttttttggcaggatttattttagctgcagtttcgtgaaatgaacatgggctggagcctgcatgtataggctgattgaggcggaatcacattatcggagcggtttttataatgcaggcttaggtaaaaaaaataaacaggcggcatgcctgtttattttcgtttgcgtgagagagcgaagaaaaacgggaaggcggaaccggccaaaaacgtaccgaataaaaacatgcctccgatgaacacatgatagttcaccccgccgatccaaagccccgtgattaaggaaacgatacttaatgcgatcatcacaaagccgggaatcagacgtttcttacccgttgtccgataagcaaaaagagaacagaagataccgatgacaatcggcacaatccacagataaaaaaggataaatactgacataagcaaaactccgatttttcttctatcataccaaaaacgcccggaaaaagatacgaacggcatccggcgtcaaaagaaaaaccggccgctacggccggtttttttctaacggaatgaatcgtagatcacaaacagattaagcgcgatcaccaaaaccgcaatcagccaggcgagagccgtcacccattttcggttcgtcagggcgcccatcaggcgtttgttgcttgtaaacataatcagcggcacgagcgcaaaggagatgccgaatgaaagaacgacctggctccatacgagcgcttctgtggcgttgacccccgagataatgatgatcatcggcggaatgatggtaatgaaacgccgcaaataaagcgggatacggtaacggatgaagccctgcatgataatatcgcctgacaatgtgccgacagaagagcttgaaagccctgcggccagcagcccgatcccgaagagaatggctgaagccggtccgatatagtggccgaattgctgataagccacgtctaaatcttctacatacagcccgttcttgaagaaaagcgcggcggcgacgatgagcatgcttgcgttaatcgccccggcgatcaccatcgcgatgagaatgtcaatcgtctcgaatctaaaaatctttttccgctcattatccgtttttccgacgacacggcgctgtgtcagtgcggaatgtaagtaaatggcatgcggcatcacggttgcgccgagtatcccggttgccaagagcacactgtccattccgtcaattttcgggataaacagcccttcgagaacagagccggcgtcaggtttggcaaagaaggtctgcagagcgaaggcgatcaccacgacaaacagaagtccggcgatgcccgcttccagcgcccggtaaccccggcgctgcagctctaaaatcgcgaatgatccgatcgccgcgataatggccgcttcaaccatcggtatgccgaacagcaggttgagcccgagcgccgccccgataaattctgccaggtcagttgccataatcaccagttcaccctgtatccacagcccggcggatacccatttcggataccggtctctggcgatttccggaaggtttttacccgtggcaatgccgagcttcgcggaaagaacttggattaaaaaagccatcaagtttgaaaagaggatgacccacagcagcatatacccaaatttcgaaccagctgagatattcgtagcgaagtttcccggatcaatgtaggcaatcgccgcgataaaggctgggcctaagaaaggcagaagccgcttgaatcccttgcttttgccgtcaagtgcatcctgcacggcttttgcttgcagtgattgtgctgagatgtctttgctcattatgtctcacctaaattccgatagatttttagctaaataacaaaaagtttcctagatgcaaattattttatctacatcataaatccgcttttatgagatgtcaagttctttatgttcaataaaccggtacattgatgccctgttttatctatgatatgtatcccgccgaagaaaggtccgaaaatgaaaacggcatcgttccgggaaagaagcgatgccgttcgcaaagcatgtttccgcgtccgatcatgcgcggatgcgttgagcgttcttttaaaaaggtgaaaagagaacacttgctcatatcacttcacaactttctgtccggtgcaactgatcctgagaaaaagacgcagtatttcctccgtttcccgggtaaatagaataataatgtttctttccattggaagataaaacctttctgtaccattcaaatgacctccggaaaaactccggccgctctgaataaacgtttgaatcaacgatatatcagtgattccagtccaataaacggctgttatctatcaaaaaaagaatcggcatggtcacttgcgaagaaaagaagttggagcattagacttatttcagtcttccgggcaaaaaagtataataacgtcaggaaagctttccggccatatgataaaagagggggaattttcttggtacgtcgtttgtcgatcatttctttagccatgatttttgctgtttctttattcgcttttggcggctctgcatcagcagcagctttcaaacctaaagctgaaccggacgtttccattttagccagcgggggcacagtcggtatttacggtgctaatatgcgctcatgctctaaggtcagctgttcaacgatcacaacattctcaagcggtaaaaaaattacaggttcttgggtcaccggagaatatgttcaaggccactacaccaattccaataaatggctgaaagtcacgtatgcaggagcgacaggctacgtttcagtcaccacactatcttattattacggtttataagcagaaaaacctcgttctcttgagagcggggtttttctatattccgattcaatttccgcgtttcgtttcatcatcgtgtttcatcagctgatcgatttcttctttagaagcgttttttttccactctttcgcctgacttgtcgcaatgggaatagcccgtccttcttcataaccctcatctaccatcgcattcgcgatttcgatcgcttttttcttcacaggttcctcgagattcttcaatgattgcggataatccttcatagaccaaggcatgtctatcactcctttatgaaaagtgtttcccgcctgaagaaaaagaaaaccgcctcatcaaaaagaatgacagctatttttacgagagaccagcaatttccgaataaaatataaaggataaagaagcaagtacagattgaatgcccaccacatgagatcaaaatcaccgataaatacccaaaaggcaatcgcttgcaggcctgaacaaaaggtcagcacaagtgatattaatgcgaaatggcgccataacgaatgtttccgtttataaagaaacaagctgtacagcccggtcaatgaaatgaaaatatctaggggaaagaatgaccagttccaggccattatcatggcgttatcataatctttaaacgccatgttttttggaatctactcaaaaaaagtaacaatccaataaatgataaatccaatatctgtaatgaggaagagaacctttaaccctttcatcacctgtttctgtccgtatgaacgctgatgccgtttgatgacgtttcactttcggaaataaagtttaaggaaacgacaccgatgatgatcagaagaacagagacagcttttataacagagaactgttcatgaaagaaaaaaattccgatcgcggaaatcagtacgatccccattcccgaccagaccgcatacgcgatggagacacttatatatttcaaagtcaaagtaagaaaacaaaggctgccgatataaaacaataacaataaaatacttggaacaagttttgtaaatccatttgataatttcatgctgatcgtacccaatacttcaaaaatgatcgctaaacttaaataaatccattgcatacagcattctccttcaatcgtattattcaaaattataaaatatatagaatttgaagaaaattaatcaatggaatgttttccggataaaaagtccggccgggtgtaaaaagaaaacgccataaaggtatactatgtagaaagaaatcagaaaggacgtgcaggacgggtgacagaagagcggacagacctggaaagacaactgagagacattcaaaaatgggaaaaggcgcagcagagggcgatgttctggcaaacattcacccgcttgccgtttcagcttttggacaagctgacaccgcaatttattcagaggaaaatcggactcattctcgatgaaacgggaacgtttattcagtcaggcggacagtaccttacatcagaaaagcgcatcatgaaaaagtttcaaaaacggctgccgcacggtacatgtcaaacgcttcacgacatccgcaatgcgccgcttgccgtcatggacgaaatcgcagaagccatagcgcgtacaagcgtaaaggccgcgacggtgcagggagccgcaacgggagtcggcggcgtgtttacgcttgcggcagacattccggcgatgctcggcctgtccttaaagacgctgcaagatatcgcggttgcttacggctttgatccgaaagacaaaaaagaacgcgtgtttatcgtcaaattgcttcagcttgcatccagtgacgtcatcggaaaaaaagcgatcctgcaagatttacggcaatatgatcaaaacgaccaaacctatcagcgcgtcgcctcgcaaatccaaggctggcgggaagtcgtttacagctaccgcgatacgttcgccgcgaaaaaactgctgcaaatggttccggccgcaggcatcatcttcggcgcgtccgccaaccgttcagctttagaaagcatcgcggaaacaggcatcatgctttataaaaaacgccggattctaaaacgcatgaacgatacagaatgataaaaaaccacccgaaaacacattcaatgtgttttctttgtttatcagttctgaaatcgggaaaccaacaaccaacaccaattaaaggaggaattcaaaaatggcacaagataataacaaaatgagcagagaagaagcaggtaaaaaaggcggagaagctacaagcaataaccatgacaaagaattctatcaggaaattggtcaaaaaggcggagaagccacaagcaaaaatcacgacaaagaattctatcaggaaatcggtgaaaaaggcggagaagccacaagcaaaaatcacgacaaagaattctatcaggaaatcggtgaaaaaggcggagaagccacaagcaataaccatgacaaggaattctatcaggaaatcggccaaaaaggcggagaagctacaagtaaaaatcatgacaaagagttttataaagaaatcggccaaaaaggcggaaacagacgaagcagctaataaaagcataaaaggcagacaacctgcagatcaaaagcgatccggcacatcagccggatcgcttttgattttgggaaaatcttgatctgagccgcaaaaccgatacaataaaatgaaaaaggggtttttcactcgtgtctgacatgctgaatttgctcgctatcgccataaagtcaaagaaaaacacgacaatttttcaatcgcggagatcaatgaccactgtgtgcgcctcgcagtgtttacgggagaatatgactggcaccatcaccctgactcagatgaatggttcatcgttctggaaggtgagctgctgatcgattttaaggacaaagaaaccgcagtgctcaaagcaaatgacagcctgctcatcccgaaaggcacgattcaccgcacccgctcttacgtcagaaccgtgaatctctgtgtcgagcatacgcatgcgaaaacagtcatcacagaggaacggtcatgctgatcaaaaagattgtatgtgaaacagacgctgcaaacgctgaagcatttgcgcaagcacagtcaaggtggggagcattatcatgtgtaaatggcttcgtcagacaggcaggcggctggcggaaaaacgcagacggcctgttcatcgcagagatcatcagcgtttgggaggacagacaggcctatgatgattttatggagaacgaacatgaccgcatatacgaagaaaacgagcagaaggctgcgattctttcaatagaagtgatgctgtacgagggggatgaacctgtcattcacgagctgttacatcaccccgacatccggtacgaaccggactggacagttgtgcgcacataaaaaaagcccctttagaggcttttttattttcgtccgggaagcgtgttgtggacatacggcgggacggggtccagcttagctatttcgccgtgcgctttcggttccttttcgtattcaaatggttctccgtccggcgctgtttccttcagccaattttgttcagcgctttctgctccatctgagaaatgaataagcttatgggagaatgactgtttttccagcgccttcgggaatgtggaaggaacgatcggaccttcctgttcttctaattctttaatggccgcaagccattggttttgatgcatggtatcgcgggccaataaaaagctgagcatatctttcacgcctttatcatcggtcatttcatacaggcgtgcgacttgaagccttccttgtgattcggcgttcagattggcgcggaagtctgccagaaggtttccgcttgcgacgatatagcctgcgctccacggaacgcccgtgctgctctccggcattgcgccgagtcctgagacaatggcatgatgcgggttcatcccgcctaaaatggacccgatgaccggatcatcagccgctttttcctgctctgccagcggggcgtcttctaacagtctcgcaatcatcgtcgcgatcatttcgacatggccgatttcttccgtcgcggtatccatcagaagatccttatatttttcattgcctcgtgtattccatccttggaacaaatattgcatggcgacggatatttccccgtattgtccccctaaaatttcctgcatcttttttgcgaacagcgggtcaggacgatccggtttagccggatgctgcagttttttcgtatgtgtaaacatgtctccatctccttttttgctctgtccctatttacttccccggcgggaaaagggatgaaacggagatgggcgtattggtcctgctaaggctcgcggcgcaaggataacaaatcctgcacaagcccgcggccgatcacctgttcatattgtccgtaaatcgggtcgaggcgtttcatccatgtgttcttttccgctttgctcagcacatgaatatgaatggatgaattcttctttatctcttcaagctggtctttattcattttctcagcggaggcttcgttccattccgtcgtttctctcatcgcctccgttaagatggttctcgttttttctgtctgtgaattccagaaatgctcgtcggtcatcacggcataaccgaggtacccgtgattgctgattgtcaaataatcttgaacattataaaattttttagaatagatatttgaaatcgtattttcctctccgtctacgagattgctttccaagagctgaaacgtggaattaaaggaatcctgccgcgggtgcgcgctgagcaggcggtactggtcttcgatcacgctgctcggcatgatcctgagcgcctgtcctttcaaatcgtccggagagaagatcggccctttatttgacgtgagctgcttaaacccgttcgtccagtacgccagtcctttcaaatgatgcttttctaaagaagcgaacaggcgcgtgccgattttgccgttgaggccttcttgcacggctttatagtttgtaaacgcgtacggcagatccaaaacaccccattcgggagacagtgatccgagctttgaggtggagggagcgatgaattgcacgtccccgttttggagggcgtttatttcttcattatctgaatagaggctcccgtttggaaatacctctactttaatggtaccgccggacttttgatagaccaggtcggcaaatttattcgccgcccgccctttaggtgtgttttcagccacgacatgactgaatttgaaaaccatttgatctttcaggccttcctgttcgtcatcataatacggttcttctgttgagaaacgatcatgaaagccgatgaataaagcggttccgataccgagtaccatcaggctgagacaagtcagcaagcttttcatcgaaaaccccctccgccattttctataacaagcataatcgggcgggccgttttcgtaaagagacggaaaggaagaggccaatgacgaaaaaaaagcttaccatccgctggaaaatcaccatactttcttatatcgtcgtgctttttacctttttgatcgtcggcatcgtgctggtcggcaatatccagcatacagaggagcgcgagctgaaaaaacggctgatgaataccgcgcggacggtatctgagatgaccgatgtcaaacgcgccctggagcagaaaaaacaaagggaagacgtgcgccatgcggtcgaagaaataaggatcatcaatgaagcggactacatcgtcgtcatggatatggatcatatccgctattcacatcccgtcagcacaatgatcggaaagcgttcaaggggtgaggacgaagccgcggcgttcgccgagcacatttatttttccgaagcaaagggagagatcggcaccgccgtccgcgctttttatcccatcaaagaccgggatttgaatcagatcggcgtcgtccttgccggtaaaacgctgcccggattcggtgaaattcttcttcagctgaaacatgaaatactgtttatcgttctgctggcgctcgggttcggactggccggctcctttttgctggcccgccacatcaaaaaacaaatgttttggctcgagccccatgagatcgtgagaatgtatgaggaacggaccgctacgtttcactcgatgaatgagggcgtcattgcgatcgataatcagcatcacatcaccatttttaatgaaaaagcgaagcagatattcaatgtcagacaagagaccgacggcaggctgatctgggacgtgttaaaagattcgcggctccctgaaatcgtcgagcggaaccgagccgtatataatgaagaaatccaagtcagcggaaaggtgatcatgagcagcagaattccgattgtcatgaaaaagaaggtcatcggagccgtcgccatttttcaggacaggacggaagcggcgaaaatggcggaagaactgacaggtgtgaaaaattttgtcgatgcgctcagagtccaaaatcatgaacatatgaacaagcttcacaccatcgcggggctgattcagctcggaaaatcagaaaaagcgctccggcttgcttttaaggaatcatcagaacaagaaagcgtcactgattttcttcatcaggccattcagaatgacgccgcggcggggctgctgttaagcaaaatcaaaagaggaaaagagcttggcatttctgtgaaaattgatgaaaacagcagtttctcggcatttccggagcatgtcgaccagcatgacatcgtcgtcctgctcggcaatttaattgaaaatgcgttcggcgcattcgaaacagcggacacggaggacaaacatattgacatcagtatcgagcaaaatgatgaagtgcttgctatattaatagaagacaacggaagcgggatttccgatcagcatatcccgcgcctttatgacaaagggtttaccgtcaataaaacgggaggaacgggatacggcttgtacctcgtcaaacaaatcgtcgacaaagggatgggcgtgattgaagtcgacacacggcagggacagggaacggcattttctatattatttccgatgaagggggaggaatcattcgatggacatcaaggtgctgcttattgaagatgatccgatggtgcaggaggtgaataaagaatttatcaccggtgtttcagggttcagcgtcatcgccacggccgctgacggagacgagggaatcaggcttataaaagatctgcggcccgggctcgtggtattagacgtatacatgccgaaaaaagacggaattaaaacgctccaggaaatcagaaaacaaaagctcgaagtggacgtcatcatcgtctcggccgcaaaagacaaagaaacaatccagcttatgctgcaaaacggtgcggccgactatattttgaagccgtttaagctggagcggatgagacaggcgctcgaaaactataaacaatataaacggaaaattgaagagcatgacacgatgtcgcaagagcagcttgacatgctgctgaaaattccgcaaaatccgtcccgggatctgccgaaggggttaaaccattttacgatgaatgaaattttgacctatatgaaacagcagacggagccgctttcagctgaagaagccgccaaagcgctcggaatcgcaagggtgacggcgcggcgttatcttgattttcttgagaaggacggccagattaagctcgacattcaatacgggggagtgggacggccggttaaccgctacaaattcgtccgctagccgagaccaaaaagaccaaaatgtccgttatgatcataagcttcccctcttcgtatgaaaacgctatcatctttgtatagacgcatcgagaggcaaggggagtagggatgaaaattttcaaaaatcttacggtgcaggtcatcacggcggtgatcatcggcgtcattgtcggactcgtttggcctgaggccgggaagcagatgaagccgctcggcgatacatttatcaatgcggtaaaaatgattatcgcaccgatcatattcctgacgatcgtgcttggcatcgccaagatgggagacatgaaaaaagtcggcaaagtcgggggaaaagcatttatttattttgaagtcgtgaccaccatcgcccttattatcgggcttctggtcgtcaatatcatgaaacccggtgagggccttgattacagcaagcttgaaaaaggggatgtctctcagtacacccaaaacgggggacaggggattgactggattgaatttatcactcacatcgttccgtcaaatatggttgacgctttcgcaaaaggcgacattcttcaggtcttattcttttctgttttattcggtgtcggcctggcggcgctcggtgaaagaggcaaaagcattattgatttctttgataaactgtcgcacgtttttttcaaaatcatcggctacatcatgcgcgcggcgccgatcggcgcattcggggccatggcctatacgatcgggcacttcggccttgattccatcaagccgctggcgagtctgatgctgtctgtatacgttacgatgttcctgtttgtatttgtcgctttgaatatcatttgcaaactattcggtttcagcttgtggaactatctccgttttattaaagatgaactgctcatcgttctcggcacaagctcttctgagtccgtccttccgcggatgatggataaaatggaacgttacggctgttccaaatcggttgtcggccttgtcattccgacgggatattcttttaacctggacggcacctcgatctatctgtccatggcgacggtttttctggcgcaggtgttcggcgttgatcttaccatcggccagcaggttacgatcattctcgtgctgatgctgacatcaaaaggcgcggcgggtgtaaccggaagcggatttatcgtgctcgcctccactttatcggcgcttcaggttattccgctggagggactggcgctgctcctcggcgttgaccgctttatgagtgaaggaagggcgatcgtcaacctgatcggaaacggaatcgccaccatcatcgtagccaagagcgaaaatgagtttgacgaagcgaaaagcacacaggccgtaaaagaaataaaaacggcggtataaaaggaaaggaacggcatgcatccggcatgccgttctttttttcggccgccatgagtaaaaaagataaatttgtttaaatttattaggaggtggacaaagaccttagcgtcattttgttatataatttacaattagagagtgaaagatgaaatctaagggctttttgtcctagcaggagtgtataaatggcggctatttttaaattttttcagcatccgggtgtcagacgtttttccgtttttcttgttttgactggggtgttagttgtattccgaagtatgattaatttgattttgcttacgtttatttttacttttctgatggatcggctggagactgtcatccggcacgtgttgaaccattttttccggatcagccagagggtggtcatcaccattttatatattgcgctggctgtcggggcgactgtcggaggctttgtcttttacccgattgttgccaagcagattgaacagctgattaagcagatcaagcacatcgcgtatcatcccgatgtcattccgttttatgatgagatatcgagcgtgttcggcgatatcaatatcggttcctatgtaaaagaaggttttaatgtactgtatacatacttggccgatatcagcactttcggtttgcaggtcgtgatgtcactgattctcagcatgtttttcctgttcgagaaaaagcggctcacggagtttatgaaaaaatttcagcacagcaagctgtctgttttttactacgaacttgcttatttcggcagcaaatttgcgagaacattcggcaaagtgcttgaagcccaatttattatcgcgctggtgaactgtatcctcaccttgatcgcattggcgattctgcattttccgcagctgttcggcctgtccatcatggtctttttcctcgggctcattcccgtggcgggtgtggtgatttcgctcattccgctcagcatcatcgcgtatacgacgggcggcgctgcgtacgtcatctacatcgtgctggtcattttcgtcattcatgcgattgagacgtacttccttaatccgaaactgatgtcagcaaaaacggaactgccgatcttttttacctttacggttctgattttctcagaacatttcttcggcatttggggcttgattatcggaattccgatttttgtgttcctgcttgatattctggatgtcgtcaataatgaggagaaggaaaaaaacggaccggtcccggataagacataacgacggctccggctcttcacgaatatatgactaatgttataatgcagacagtgcctatgtacgggcactgtttattttttgtgaaaaaggaggaaggctgtatgactgagccgattttacatattgaaggccttgacaaaacaataggcaaaaagcacattttaaaaaacatcagcatggatgtcaggcagggcgagatcatcggtttgctcggtccgaacgggtcgggaaaaaccacacttatccgaatcatcgtcggccttttaaagaaaaacagcggcacgattacaattaacggctttcagcacgatgctgatttcgaaaaagcgcttgaatccgtcggagcgatcgtggaaaatcctgaattctacccgtacctgacggggtgggaaaatctgaagcactttgccaacatgcacaaaaacatcacagaagacaggcttcaggaagtcatcgagcgggtcgggctcacaaatgccgttcatgacaaagttaaaacgtattcccttggcatgcgtcagcgtctcgggattgcacaggccattcttcaccgtccgaatctgctcattttagatgaaccgacaaacgggcttgatcccggcggaatgaaggatttccgcgatcacttaaaggaactcgcggagcttgaagggacgagcatcctttttgcgacgcatttattgcgtgaagtggaggacctttgcgaccgtgtcatcatcattcaaaaaggtgagatcaaaacagaggttgttctgcgcggcgctgcggaaaaagaagaaaaagccatcctcgacattcagccggctgacgaagccttcgaatggctgtcccagcagcaattcgttccggagaaaaacggcgggagcattaccgtcaccgtagcgaagaaggacatcccggcattaaaccgtgcgctcgtcggacaagactttctcgtgtattccatcatgccgtatgcggaatcgctggaggatgaattcatgaaagtgacgacggcgcttcaagaggaggggaagacgaatgtttaaattgacagcgaatgagcatatgaaactctttaaccgaaaagtctcattagtggcgctgattctgatggccgttctccaatttattatggcgcttgtcattaaacggcttgtcatcagttccggaacggatgagaatttcatcggctatatggcgtacgcccccgggctgaatattctgcttgaggcattaacgatcgtgatcgcggcaacgatcatttccgctgaatttgataagaaaacgatcaaatttttgttaatccgcccggtaaagcgggagcggatttttgtatctaaactcattaccgtatttttggtcagcttgtacctgtatgcggcgtactatattctgtctctgctgttcggcatggctttcttcggagtgtcggtgacatctgaatcagggacgcttcttgtgaacaccctgaaagtaatcggcacgaactgggtcgaggcgtttgcgatggcatgctttggcttgttgtgttcttctgtattccgaaacagcgcaacggccgtcattttgtcatttatcgtgctgtacggcgcaaaatcacttgtgacgattatgtcgctcttccaaaacaaatggggtagttttctgctgttcgcaaatactgacctgacgcaatatatgagcggggcgaagccgctgtttgcgggaatgacgccgttattttccgcaggcattatcattatccatatcgtattcttcttagccgtcgcttggtggagcttttgcaaacgcgatattcgggtataaagtaaaggaatgacatttttgtgaaaaagatcacgataaatcaataatttatgctattttgatttataataaaggtaatgacggaggtgctcacttgagaaattttattaccgcattaccgattgtgttattgcttggtttttcctttgtgtcattcatgtttcaattcgaacatcttgtttatttcaggcttgcgctgggtttgttttctacagtggggctgtttctcttatataaaatgaagacgggattccgttatttcatcatctacctgtatgcaagctggatcgtgcttgcggcggttaccgcgtttgaagagccgattttttcaagctttttctttggcgggcttgtgatgacgatgggttatctcacatatatgctgatttatctcgggctcaagcaggaccgcggcccggaagcagtctgaacgcgctattctatggaatagcgcgtttttttgtacagcctcacagttgcgaaacgagacttgaatctctataatacttattaactttatcggaattataatggggggattccagtgtctttatggatacagaatgaacggcagcgggaatggatggaaaaaatcggcctgcttgcagacgaatttcaaaaaacagccgcgcttgatgatgaggcgggccgttttcccgcggagaaaattcaaagactgcgcgacgcgggatatacggcgttaacggtacctgaggcattcggcggtgcaggcatttccgtttatgagatggtgctgtttcaggaacggctggcgcggggagacgcggccgtcgctctcggaatcggctggcatttatccgtcatgggtgagctcggagaaggaaacagctgggatgaaggtgtcttttcatttatcacaaaagaggtgaaaaagggagccgtcctgaacagggcagcgacggaacggcagaccggcagtccgacgaggggaggaagacccggcacttccgctgtcaaaaaagacggaaaatgggtgctgaacggccgaaaaacctttacaaccctttcactgactttggattatatgcttgtgacggcatggattgaagaaaaacaaacgaccggtgtttttctcattcataaagatcaggcaggcgtttcagtcgaagaaacatgggatatgattgccatgaaggcgaccggaagccatgatctccttttagatcatgtcacggtcagtgacgagcggcttgtggagcttatcagcgggccgagagcggcgaaagtgaatggctggctgcttcacattcccgctgcttatctgggcatcgctcaagcggcaagggactatgccgtccggtttgcatctgaatattcgccgaacagcctgaacggaccgattaaagacgtgccggccgttcagcagcgtgtcggggaaatggagcttgaattgttaaaagcgagacagtttctcttcacggcggcgcaaatgtatgatgatccgaaacgccgccctttcatcaaaagcgagctcggcgcggcaaaacatattgtgacaaatgccgtcctttctgttgttgacaaagcaatgagaatcaccggcgcaaaaagcctggagcgaaataatccgcttcagcggtattatcgggatgcccgggccggccttcacaatccgccgatggacgatgcggtcatcggcaaattagcggcggaagcctttgagcaataaaaaaaagagcctgaaaaaggctctttttatgtatggctgttgtgccggagcagtttttgatgcttgcggtcaattctgtcatagatcacattcatcagcttttgattattcataatggccgccttgttttcttttatcagctgttcgtatgtttttattttacgtttcgccatgagcccgcaccttccttacatatttgtattcgctttctaattctccgagcgataattcatataaatgccgttccgactttttgtatattccgttattgatcagcaaatggatcagatgtttttttcgtccttcaactgatgatctgagctgaggagaagacctcatgattaccctcctaatcaattgatattgagaatcattatcagttaatgaaattatacaatggacatattcatatgtaaaggaaaaataccgccaatttttcgacaaatagtttcccggggaataatgctgtcgaatattgcatttggtcagatcaaagctgctatttttccgcttttccatccatactatgaatgagaatggaggagtccttacatgaatgatcaaacggcaaacttaaaacggggcgaaaaaggcgcgattcttaatatcgccgcgtaccttatccttgccgccgtcaaactggtgatcggtcttatttatcattccgaagcgctcagtgcggacgggttaaataatgctacggatattgtcgcatcactggctgtgctgatcgggctccggatttcccagcgccccgcggacagtgatcatgcctacggacattatcgggctgaaacaatttcttcattaattgcgtcttttattatgatggcggtcggtattgaagtgctgatcggaggagcaaaggcgattgtcagcggaacggaggccgagccgagcttcattgcggcatggacggcgctaggaagcgcgattgtcatgtacggcatgtatgtatataacagccgtcttgcggatcgggttaaaagttctgcgcttcatgcggcggcgaaagacagccgttctgacgcctatgtcagtattggggcgttgataggcgtcttaacggcccggcttcatctgccgtggattgatccggtcattgcttttctgatcggaattatcatctgtaagacggcatgggacatcttcaaagatgcttcccactcattaacggacgggtttgatctgaaagatttggagccgtataaacacacagtgaaagaaataaaagaggtcagcaggctgaaggatgtgaaagcaaggtatttggggagcacggttcatgtggaaatggtcattacggtagatccgggactgtctgtgaaagaaggccatgaagtagccgatgaagtcgaatatgcaataaaacatgaacatgatgtgactcatgtccatgttcatgtagagcctgaagtcataaacaaagatcgtgaaacgaattaaatatgctgtgataaaaactctgtgacttcttcgggcgttttcgcgtttgcgctgtgaagatgcgctttcttttcgccgtttttaaagatcagaaggctcggtatgcccattacctgatatttgtcggcaagctcagggagctcgtctctgttcagctcataccaatcattttgattatattcttccaaaatatcgccgatgaacatattcatgcgcgtgcagtcagggcaccaatcagcgaaaaatttcacgatgatttccttgtcggattgaataagttcattaaattgttctgttgtactgatttttttcatatgacacatctccttttccatgccattttaatataaaataaaaaggaattacatacaaatgctttcatattcagaatgcccaaaaataattagatcattttctgaggaaagtgataagatagtaaagatgaattgttgtggggggaatatccattgaaaacaagtctaggattggtgtacggcggaaagtcagccgaacacaatgtatcgctgcagacagcattagctgtaacaaaagcgcttaatactgagaagtttgatatacatccgatttacatcactgaaaaaggagaatggcaaagaggcccgctgctgactgagccggtttccaacgtgaaaatgcttcagctggaacaaaacggtgaaagtttcgctctatcagcattgaaccgggaaatgtttcctgaagcgtcgcctgacgaaaaggcgcagatcgatgtcgtatttccgcttctgcacggaccgaacggtgaagacggcaccattcagggactgctggaattgctgaacgttccttatgtcggcaacggagtgcttgcatcatcagccggcatggataaagtcatcatgaagcatttgttcgctcaagcggggcttccgcaggcgaagtacgccgctttcttaaaaaaggactggaaacagacgccggacagctgcttacagcaggttgaagaggagctgggatatccgtgcttcgtcaaaccggcgaacctcgggtcaagcgtcggaatcagcaaatgccgaaatcgcgaagagcttgaaaaagccttcgaactggcttttgagtatgaccggaaaattgtggtggaagaaggaatcgccggcagagaaatcgaaatcggcgtactcggaaatgacgaaccgaaatgttccgccgtcggtgaaatcacgccgaaaaccgacttttacgattacaaagcgaaatatgaagacggcgacacggatttaatgattcccgcgcaagtgacggatgaacaatatgcggaaatcagcgagatggcgattaaagccttcaaagcgattgacggatcaggccttgtccgcgccgatttcttcctgaccaatgacggtcaagtgctcattaacgaagtgaacacaatgccgggctttacgccattcagcatgttcccgctgctttggaaagaagcaggcgtagattacagtgatctgatcgaacagctggttgagctggcaaaagaacgccatgccgaaaaacagctgattaaacatacattttaatgaagacggacactgcctgaaggggcagtgtcttttcccgtaacagacaacattttcagaaagcgaggtgccacctttgataaagcgaactgtaaaacgaatcgccgacatggtcaaaggcacactgacaaatcctgtatttgaacaaacaatgattgagggcgccgcaaccgatacgcggactttggaaaaaaatcagctgttcattcctttaaaaggcgagcattttaacggccatacctttgtgccgcaagcattcgaaaaaggcgtttccgcggtgttgtgggaccgctctgaaccgaatccgccggaagagcgtgccgtcatccttgtcgatgacacgctggaggcgctgcagacattggcgaaagcttatttgaaagaactcggcacacgggtcatcggggtgaccgggagcaacggaaaaacgacaacgaaagacatgcttcacgccgttctcagcactcagtaccgtgttcacaaaaccgccggcaatttcaacaaccatatcggcctgccgctgaccgtgcttgccatgcctgaagatacagaaatcgccgttttagaaatgggaatgagcgcgagaggcgaaattgattttctgagccgtcttgctgaaccggaagctgccgtcattaccaatatcggcgaatcccacatgcaggatttaggctcaagagaaggaattgcggaggcgaaacttgaaattataaacggacttcgggaagacggcgttctgttttatttcggggatgagccgttgctccgcgaaaaggcgtacacttgccggacaacgacatacggcgcaggcgctgtcaatgatctccgcctgaaagaaataaaacaggcggaagaaggcacgtacttcaatatcgacgggatcgaacgttctttctttattccggttctcggcagacataatgtgatgaatgccatggccgcatacgccgccggcatctatttcggcattacgccggaaaatgccgctctgggactgagccgcctgaaggtgacggggatgagattggaactggttaaaacggaaaacggcatctcgatcgtaaacgacgcgtataatgcgagcccgacgtcaatgaaagcggcggtcgaattaatcgaaacgatgaaaggctatcggaagaaaatgctcgtgctcggtgatatgcttgaactcggtgatgaagaaaaagcattccacgaagaatgcggagctgcgatcaatccggcggaaattgaccatgtatttacttacggcacactcggcgcattcatcgcagacggagcgcgccggcattttgaagaagggcgcgtcagccattatctcgacaaaaaagaactgcttcacgccatacaggatatggccgcttccggcgatctccttctgtttaaagcatcgagaggtatgaagctcgaagaaatcgttaaagatttattagagaagaactgaaaaaatactgatcagcattataaaaatatacaaaaatgaagaaactaattcagggtgaaataattctgtccgtatgaaaaagaaaggccgccggctgggaaatcccgtccggcgcggggtccggcctcgtttgcgggaagaatccggtcaggccgcttccggccgcctgaccatctcgccttattgaaaaacacatagtgtaatggtaagattaaacgtaaagtaattcgggctttgtatacgtatgatcctgtcctttggatgaaagggcagtttttagtggtaaatcacgacattactgaaacagcaatcagaaggagtttgaataatttgactataacgtttcaagatttccaattaagttctgatctcatgaaatcaatcaatcgtatgggatttgaagaagcaacaccgattcaggcacaaacgattccgctcggacttttaaataaagatgtcatcggacaagcgcaaacaggtacaggtaaaacagctgcgttcggtataccccttgttgaaaaaatgaaccccgagtctcctaatattcaagcaatcgtaatcgcgccaacccgtgaattagccattcaagtatctgaagagttatataaaatcggacaagataagcgtgcgaaagtgctgcctatttacggcggtcaggatatcggacgtcagatccgcgcattgaagaaaaacccgcatatcattgtaggtacgccggggcgtcttcttgaccatatcaaccgccgcacgatccgtttaaacaacgtgaacacggttgtcatggacgaggctgatgaaatgctgaacatgggattcattgatgatattgaatccattctctcaaacgtgccgagcgaccaccaaacgctcttattctcagcaacaatgcctgcgccgatcaaacggatcgcagagcgtttcatgactgagccggaacacgtaaaagtaaaagcgaaagaaatgactgtgtccaacattcagcagttctacttggaagtgcaggagcgcaaaaaattcgatacgctgactcgtcttcttgacattcagtctccggaacttgcgattgtattcggccgtacaaaacgccgtgttgacgaattgacggaagcgctgaaccttcgcggatatgcggctgaaggaattcacggcgacttaacgcaggcgaagcgtatggtagcgctccgcaagtttaaagaaggtgcgatcgaagtgcttgtagcgactgacgttgctgcccgcggacttgatatctcaggtgttacccacgtatacaactttgacgtgcctcaagatcctgaaagttacgttcaccgtatcggaagaacgggacgcgcaggaaaaacgggtatggcgatgacgtttatcacaccgcgtgagaaaaacatgcttcgcgcgatcgaacaaacgacaaaacgcaaaatggaccgcatgaaagagccgacgcttgacgaagcattagaaggtcagcagcaggtgacggttgaccgtctgcgcacggcgatcagcgaaaacaacctgaacttctacatgacggcagctgcggaattgttagaagatcatgatgcagtgacagttgtggctgcagccattaaaatggcgacaaaagagccggacagcacgcctgtacgcctcactgatgaagcgccgatggtcagcaaacgctataaaaaccagcgtacttctaagcgcagagacggccaaggcggcggctaccgcggcggcaaagggaaaaacaacaaccgttcttcctacgataaaaaacgctcaagcgaccgccgttcttcaggtgacagacgccagaaaaaatcatactaaaacacaggaagcggaccctttttcggggtccgctttttttcgatatgccggaaagtgaatcttttttgcaaatcagccgtatttgtatgtatgataaaaaatgggaggtaggtatgttgagagcacagccaaaaaatcgaatcagtccaagcggcttaaaagtctggcgtcttcaggaaatcatcctgtccgccttctgtcttctggccgttatagcagcagctgttttaagccatttcttccattggccgtattggatcaccggagtcctcggcatcatttgggtcatcggttcagtgatatccgtctatgccataccgaaaatcaggcacaggatctggcgctatgaggtccatgaaaatgaaattgatattcaatccggcatttttatagtcaaacgggtcattgtgccgatggtgagggtgcagcacgtagatacttcacaaggcccgctcctcagaaggtaccgcctggcctcagtcaaaatctctacggcggcaaccgttcattccattccggcgcttgatatggaggaagctgaccggctgagggattccatttcccgtctggcaagggtgacggaagatgatgtctgaaccgaaacgtctgcacccggcggccgtgattttgaacttattccatattattatcgaaaccattaaaaacattattctgccattttttctcgtctatattgttaattccaaccacttcatccgcttttacggaggcattgcgctcgctgtcctgcttatctggctgattacggcaagtgtgatcgagtggagaaaatttacataccggattgaggacggagaattcagaattgaagaaggcttgttttttacgaaaaagagatacatctccattgaccggattcaatcaatgaatacgagtgccggcatcgttcagcagctttttaagcttgttaagcttcaaatcgaaacggccggcgacgggaaaaacgccgaggccgtcttatccgccattactgtggaagaggcggaacggatcagagcggctgtttttcagcaaaaagcggagcaagaagaacgaggggagaccgcagcggagcaggagccgatgcgcggggaagatgtgcaatccgtttaccgcctgtctgtgggtgagctgcttatggccgcctcaacatccggggggatcggtgtcatcatctcagcggtattcgccctcttttctcagcttgatgaagtacttccgatggactggttctacgacaggttttcttttctcaagcatgcgagcatcggcatatacgccgtgatcatttttataggattgttcatcgcctggctgttaagcatcgccggtatgatgatcaagcatgccaactttaagatagaaaaaaaggaacacgaattggtcattacgagaggaattattgaaaaacatcaagtgaccatcccgctccgtaaaatccaagccattaaaattaaagaaaatgtgatcaggcagttattcggatacgcgacggttgcgattgtcagcgccggcagtgcggggaatgagaaagaaggagctcagacgattctgtttccgatcatccgcaaatcaaagctcggtgtgatgctgaacggtttcacaccggattacgtactggaagaaaataggaatcatttgccgaaaagggcgctgcgccggtatttattccgctccgttatcttctcggttttcgtgatcattccgctttgtattctgtttaaaccgtgggggtatgcatcgctccttgtgcttcccgtcgaactggtgctgggctacgcctcatttaagagcgcgtcatggtgcttaaacggaggccggctgcagctcaccacacggctgatcgggaagacgaccacgattatgctgagaagaagaatgcagatgtttgaagtcagccgctcctttctgcaaaaaagaaggcggctcgcatctgtggctaccgcagtgaaatcagctcaccacatggagcatgtcatgctgaaggatgtcagcgaggaagatgccgaacgcatcgggcgctggtattcatatgaaaaagcggacggttaataccgccgctttttttgctgcacgcataaaaaggaaagcaaaaatccgcctgccagtccgaacaaatgcgccataatgttaatattagaattgataaacgtcgacagtaccgcgatgataagcagggtcataatcattttcgactggtcccggccgatcagctccttgcggaaaacagtcagaaacacatacacgccgaaaagtccgaaaatcgcgccggatgcgccgacatgcacataatcaagcggttcggcaagatatgtgccgatattgccgataatgcccgatgcgatgtacacaatcaaaaaacggacttttccgagcatctgctccagcgggggcgcgaataaaaagagagacatggagttaaacaaaaggtgagtgaaattcgcatgtaaaaacatcggtgtcaccagccgccaccattctcccgaggaaacgccgtaattatagccggtcactgcatctgaccacatcatgacggaatgaagcggcatactgaaaaacagccacaagaacgcctgcagcgccaagatacagctgacggccggataacgtctgataaaagtctggaaattttccgtacgtataaacatcgcaagcccctttgcatctgatttgttacatatatagtaacacgtttatgacataaaccgttttttagtacggacttttaggaggaattcacatgattttcggaatcggaatcgacatcgttgaactgcacagaattgaaaacatgctcagccggcaggcgaggtttccgcaaagaatattgacggaggctgaatacgcccgttttacattgctgtcggacaaaaggaaaattgaatttctcgcgggaagatttgcggcaaaagaagccttttcgaaagcatacggaacgggtatcggcaaagagctcagctttcaggatatcgaaaccggaaacgacacggcgggcaagccggtgctgacctgcgccaagctggacggcgcggcggttcacgtctccattacccatacaaaagaatacgccgcggcacaggtcgtgattgaaaggttgtcacgctagtctgcatattagccgaaaccccttcatatatttgatagtgcattaagggagacaagttgtttgaggcttttatggtacgcgtccgtccgttcagggcgtaccgttaaagtcaaacaagcgatttcttccctttacatcaattgagaagaaggggttgaaaaaaggtgagaaaaagctttgttttgcttttaacgggactgcttgccgtccttattctttcggcctgcggccaaaaatcacaggaagatatcgtgaacggtttagataagaaggcgaaagaatacacctcgtacaaagcgaaagccaaaatgaccattcagacggggagtgatccgcaagtatacaatgtggaaatctggcataaaaaaccttccctgtaccgggtctatctggaaaatccgaaaaaagaccaaaaccaagtcattttacggaacgccaacggagtctttgtccttacgccgtctttaaataagagcttcaggttccaaagcgactggccgaataacagcagccaagtatatttgtttgagtcacttgtaaaggacgtgcagcatgacaaagacgccgtctattccgccaaagataaaaagtacacgtttgaaacaaaaacaaactatcagcacaacaaaatgctgccgactcaggaaatcactttcaacaaaaaggacatgagcccttcgctcgtcaaagtcatggatacagaccggaaagtgatggtaaaagtcgaattcaaaagctttgaattcaacaagccgtttgataaagactcttttgacgagaagaaaaatatgacgctttcccagatggacgtcgccacaagcgccaagccgtctgattcatttgcggtcaaaacaccgcttcaagtgccggccggcgtcaaaaagcttgaagagaaagatatttcaacggcggacggcaaacggatcgtcatgacttacggcggagaaaaatccttcacccttattcaagaaaaagcccatatcgcaaaagccgcctctgccgtcacgctgaaaggcgaaccggttaatctcggcttcacggtggccgcattatctgatacgtctttaacgtggacatatgacggagtggattatcttctgtcatcacaggatctgacaaaggatgaaatggtggccgccgccaaaagcatgcagggacagtcgtcaaaataatgtcaaaaaagaggccgccgctgtcggtctcttttttgattccatttcactttgcagaataattttagtatgataataacaatatgaattgaaaataatgctaggaagtgtatcgaatgaacacagcatccttttacagagaaacgtgggcggaaatcaacctgtccgcgattaaagaaaatgtcacgcatatgaaaaaacacatcgggcaaaacgtccatctcatggcggttgtaaaggcgaacgcttacggccacggagatttggaagttgggaaagccgcgcttgaagcgggtgcctcttgtcttgccgtagccatactggatgaagcgatttcattgagaaaacggggcattacagcgccgattcttgtgcttggcgccgtgccgcccgaatatgtacaagcagctgccgaatatgacgtaacactcacgggatattctgttgaatggcttcaggaagctgcgcgccacctcggaggtgccacattgccgtttcatctgaaagtcgataccggcatgaacagactcggagtcaaaacggaggaagaaatccaaagcgtgttaaaaatcctcagccaaaatcccggtttagtctgtaaaggcgttttcacccactttgctaccgcggatgagaaaaacagagattatttcctcttccagtttgaccgctttaaaacattgatcgctccgctccctttaaaagaattgatggtgcactgcgcgaacagcgccgccggacttcgccttaaaaaaggcttctttaacgcggttcgtttcggcatcagtatgtacgggcttcgtccttctgctgacatccaaagcgaaattccgtttcaattaaagccggcttttgcgctgcactctgtgttatcccatgtgaaaaagatccgcaaaggggaaagcgtcagctacggcgcaacatatacggcagagaaggatcaatggatcggaacggttcccatcggctatgcagacgggtggctccgcaagctgagcggcacgtctgtgctgatcggcggcaaacggatgaacatcgcgggaagaatctgcatggatcaattgatggtcgaattagatcaatcttatccgccgggcaccaaagtcaccctgatcggcagccagaaggaagaaacgatcacgatggatgaaatcgcagggcggcttgagacgattaattacgaggtcccttgtaccattagttcccgcgttccccgtatgtttttggaaaatgagagtataatggaagtaagaaatcctttactgcaagataatacaaacaagtagccgtcatccggaaaaagagaatttataaaacagctttgcttgacgtttgaataatggtatcattatgtctggatggatgaattggtcgtatccgtaagtttggtggaggtgtatgttttttgtctgaatccagcgcaagaaccgaaatgaaaatcagcttgcccgaaaacttagtagctgaattggatggtgtagcgatgcgggagaaacgaagcagaaacgaactgatatcacaagcagtgagagcgtatgtcagcgaacggacaactcgccataaccgtgatttgatgagacgcgggtatatggaaatggcgaaaatcaacttgaatatctcttctgaggctcactatgctgagtgcgaagcagaaacgaccgttgagcgcttagtcagcggaggataatcattttgattgtaaagcgcggcgatgtttattttgctgatttatctcctgttgttggctcagagcaaggcggcgtacgcccggttttagtgatccagaatgatatcggaaatcgctttagcccgactgctattgttgcagccataacagcccaaatacagaaagcgaaattaccaacccacgtcgaaattgatgcaaaacgctacggttttgaaagagattccgttattttgctggagcaaattcggacgattgacaagcaaagattaacggataaaataactcatctggatgatgaaatgatggataaggttgatgaagccctgcaaatcagtttggcactcattgatttttagtcatattttggttgctcatatagagcaactttttttgttttcgaaaaacataagcgctataataaagaaataatcaaacaaaatttgttgttttgtgtcgggaggtcagtgaaacccatgtcgaatcagaaagtgtatcagttcattattgatcagcatgatgaactgcttgatacttggacagccaaactaaaagaagtaggcaatcaggaagactatcagcttacgaatcacatatgtgaaaatatttgtaaagattatatagacattcttttattatcgacaaaaaatgacgaggctgccgaagagcagatcagtgaactcgcactgcgcgccgttcagctcggcctgtcgctgaaacttctttcagccaccctgtcagagttttggaaactgctttacgaaacgatggtcgaccttaatatggccgatcaggacagagcagatttgattttggaaatagacagctttttcaatccgatcaacacggaaatcttaaatcagtattctatctcctgggaaaaaacggttactttgcaaaaaatcgcgcttcaggaattgtcggctccgctgatcccggtatttgagcatgtaacggtcatgccgcttgtcgggacgattgatacggagcgtgcaaagcatattatggaaaatctgttaaacggcgtcgtaaagcaccgttcacaggttgtattaattgatatcacgggcgtgccggtcgttgatacgatggtggcgcaccatattattcaggcatcagaagcggtgcggcttgtcggcgcgaaatgtctgctcgtcggaatccgtccggaaatcgcgcagacgatcgttaatctgggaattgatttgtcgcaggttattacgaagaatacccttcaaaaaggaattcaaacagcgcttgaaatgacaaatcgaaaaatcgtttcattgggggaataacattgtgagacatccaaaaatcccgatcctgaaactgtataactgcttattggtatccatccaatgggagcttgacgaccagacagctttgcattttcaagaagatctgctgaacaaaatctatgaaaccggcgcaaacggggtcgtcattgacctgacatccgttgacatgattgattcatttatcgcgaaagtgctcggcgatgtcatcaccatgtctaaattgatgggcgcaaaggtcgtattgacgggaattcagccggctgtggcggtcacattgattgaactcggaatctcacttgaggaaattgaaacggcgctcgatttagagcaagggcttgagacattgaagcgggaattgggggaatagcgatgaacgaccaatcctgtgtgaaaatcatgacagaatgggatatcgtagccgccagacagcttggccgcaacgttgcgaaggaattaggcttcggcacggtggaccaggccagaatcacgacggctatctcagaattggccagaaacatttacttatatgcaggcaagggccaggtcagcatagaacaagtaaacgacagagggaaaaaaggccttaaaattatagcagaagacaaaggacccggaatccccgacatccgtaaagtgatggaagacggcttttcaacgtcaggcggactgggagcgggacttccgggcgtgaaaaggctgatggacgaattcagcctgcaatctgttgcagaggaaggaacagagattcaagccgtaaaatggcttcggtaggaggttagaacgtggatttcagggaggttatagagcagcggtatcatcagctgcttagccgatatatagccgaattaacagaaacatctttatatcaagcccaaaaattcagccgaaaaacgattgaacatcaggttcctccggaggagatcatcagcatccaccgaaaagtggtaaaggaactgtatccggatctgccggaagatgtttttcattcgctggattttttaatagaagtcatgattggctacgggatggcttatcaggaacaccaaagtctgagagatatccagcaggagcttcgttcagaaattgaaattgccgcaaatgttcagcagacgctgctgggcacaaaaattcctgaagaagaagaactggatatcggggcgatcagcgtccccgccaagcaaatgagcggggactattatcactttgtcaaagacaaggaatcgattaacatcgcgatagccgatgtcatcggaaaaggaatacccgccgcattgtgcatgtcgatgatcaagtatgccatggactctcttccggagatcggcattcacccctcccaagtgctgaaaaatcttaaccgcgttgtagaacagaacgtggactcaagcatgtttatcaccatgttttacgcaaactacaatacgaaaaatcaccaatttacatatgcttctgcggggcatgaaccgggcttctactactctgaaaaagaaaaaaagttttatgatctggaggcaaaaggattggtgctgggaatttcccaggattttgattacagccaatatgaacagcacatggacgaaggagacatgatcgttcttttttctgacggcgtcaccgaatgccgtaccgaaaacggtttcttagaacgcagcgacattcagcgcatgctggaagaacatatggactgctccgcgcaggatatggtcaaaaatatttacgacagcctgctgagacttcaggactttcagcttcatgatgattttacgttaattgttttgaaaagaaaggtttaaaaaaacggcagcacgggtaaaaagccattagcacgagtaaggataactttcagaggtgatacgatgaatttaacggtagatatgaaggagaatctttcagatatacaaatcaatatcgctggagaaatcgatgtatactcagctccggtggttcgtgaaaagctgatgcccctggcaaacgaggggaaggacatgagaatctgcttaaaagatgtaaactatatggacagtacgggtttaggtgtttttgtaggcgtgtttaaaacggtgagcaaggaaggcggctctctgaagcttgagaatctttccgaccggctcgtccgtctgtttgaaattacggggcttaaggacatcatcgacatttcggcaaagtcagaaggtggcgtgcaatgagtacatcagttgattatatagagatgaaaattccggccgaaccggaatatgtaggaatcgtcaggcttacattatcaggagtcgccagcagaatgggctatacctatgatgacattgaagatttaaaaatcgctgtcagcgaagcttgtacaaacgctgtccagcatgcatacaaagatgaaaataagggagaagtatccgtgcggttcggtgtgtttgaggatcggctggaggtcattgtcgccgatcagggagacagctttgattttgatcagaagcagcaggatctcgggccgtacacaccttcgcacacagtcgatcaattgtcagaaggagggctcggtctgtatttaatggaaacgctcatggatgaagtcaaagttcaaagcaactctggcgtaaccgtggcgatgacaaagtatttaaatggggagcgagttgatcatggcacaaccatcaaaaactacgaaactaactaaagatgaagttgatcggctcatacgcgactttcaaacacatgataataaagaagcccaggaaacactcgtcgaggtgtataccaatctcgtcgaaatgctggcaaagaaatattcaaaaggaaaaagctttcacgaagatctccgccaagtcgggatgatcggacttctcggagccattaaacggtatgatcccgaggtcggcaaatcctttgaagcatttgcgattccgaccatcatcggcgagatcaaacgcttcctcagagataaaacatggagcgtacacgtcccgagacggattaaagaactcgggccgcgcattaaaatggcggtggatcagctgacgacagagacgcagcggtcgccgaaagtcgaagaaatcgcagcctttctcgatgtgtcagaagaggaagtgcttgaaacgatggagatgggaaaaagctatcaggcgctttctgtcgatcacagcatcgaagcggatgcggacggaagcaccgtcacaattttagatatcgtcgggtcgcaggaggaaggatacgaacgcgtcaaccagcagatgatgatcaaaagcgtgcttcatgtgctgtccgaccgcgaaaaacagattatcgatctaacatttgtgcaaaataaaagccaaaaagaaacaggggacattctcggaatatctcaaatgcacgtctcgcgcctgcagcggaaagcggtgaaaaaactgagagaggccttgattggagatccctccatggagctaatgtaatgattcaggttgaagaaaatgaacatgttcaaactcttgtataccaattaaataaagaaggcaagtccatatgcggcgacagcttttttatgaaggcgaatgaagaagaattagtttgcgcggtagcggacggtctcggcagcggatctcttgccaatgaatcctcgtcagccattaaagacatcgtggaaacgtatgcggatgaggatgtggaaagcatcattgagcgctgcaatcaagcgatgaaaaacaaaagaggggcgactgcctccatcttaaaaatcaatttcatcaaaagggaattgacatactgctcgatcggcaacgtccgtttcttcctgcactccccatcaggcgaagtttttcatccgctgccgatttcgggttacctctcaggcaaaccgcaaagatacaaaacgtatacgtcatcatacgaaaaaggggcgacattcatcatctacacggatgggcttgaggttccgcatatccgcacctgcttaaagcagggacactcaatagaagaaatatcaaaatcacttcatccgtacacaacatccagacgtgatgatttgacctatattctcgggcagcttttatcgtaaggctgctttttttatgttccgccgttttttgatacactagagaaagaaagaagagatggaggcttttgtgatatggaaacgttagcccttttgaaaaaacaaattgctgaagaaacagcgttatcccaaaaacatgtcgaaagtgtcatccgcctgctggaagacggcaataccgtcccgtttattgcgcggtaccgaaaagagcagaccggctcaatggacgaggtgcagattcaggcaatctccgagcggtggcaatacatacaaaacctgacgcagcggaaagaagaagtcatcagattgatctccgagcaggacaagctgacagacgggctgaagcaaaaaatcgagcaagcggtcaagcttcaggaagtcgaggatttataccgccccttcaaacaaaaacggaaaacaaaagccaccgtcgccaaaagcaaaggccttgaaccgcttgcggactatattctttctctcccgaaagaaaaccgccttcacgacgtcgctgatcaatatatcagtgcagaaaaagaagtcgcttcaagagaggaagccattgaaggcgcgaagcacatcatagccgaacaaatctcggatgatcctcatttcagaaagtggatccgccaggaaacgtataaaaaaggaattctcacttccgcggcaggcaagtcagccgcagatgacgagaaaaacgtctatgagatgtactacgagtacgaagagccgatccaaaaggtcgttcctcacagagtgcttgcgatgaaccgcggtgaaaaagaaggcattttaaagattgcgatcgaaccgcccgccgatcagataaaagcttatttagaaaagcaaatcatcaaacaccgtgaaacacctgtgaaagaaacgctgaaagaagccattgaggacagttataaacgcctgatccagccggctattgaacgcgatatccgcaaagaactgtcagaaaaagcagacgcgcaggcgatccatattttcgctgaaaacctgcgtaagctcctgctgcagccgccgatgaagggaaaagtcgtgctcggcgtcgatccggccttccgcacggggtgcaaactggcagtcgttgatgagacgggaaaagtgctgaaaatcgatgtcatttacccgcacgctcccgtcaaaaagacagcggaagcccgaaaaaaaatcaaagaattgctggatcggtacgaagtcgaggttgtggcgatcggaaacggcacggcatcacgggagacagagcaattcgtcgttgatgtgctgaaagaaacagagcgggacatttattatgtcatcgtcaatgaggccggagcaagcgtgtattccgcgtcagaaatcgcccgtgaggaatttccggattttcaggtcgaagagcgcagcgccgtctccatcgcgcggaggttgcaggatccgctggccgagcttgtgaaaattgatcctaaatccgtcggtgtcgggcaataccagcatgatgtcagccaaaagcatttaaacgaatctctccgttttgtcgtagagaccgtcgtcaaccaagtcggggtgaatgtcaatacagcatcagccgcgctgcttcaatatgtagccgggttatccaaaaccgttgccggcaatatcgtcaaaaaaagggaagagctcggaaaatttacaaaccgcaaagagctgaaagatatcccgcgtctcggcgcaaaaacatatgaacagtgcatcggctttttgagagtgcccggaggacgggagccgctcgaccgcaccgggatacacccggaaagctataaagagacaaaggcgctgctcaaaaaactgcagctcactgcggatcagatcggaagcgcggacgtaaaagagaaaatcagcgcactgccgctgtctgaaacggctgaggagctcggtataggggagattacgcttgcggatatttgcgggcagctgacaaggccggagcgagatccccgtgacgaagtgccgaagcctttgctgaaaaaagacgttctgcagcttgaggatttaaaggaaggaatggaattgcagggcaccgtccggaacgttgtggacttcggcgctttcgtcgatatcggcgtcaagcaggacgggcttgtgcacatctcaaaactgagcaatcaattcgtcaaacatcctctcgacgtcgtatcggtcggagacatcgtcaccgtatgggtcgaaggggtggacgtgcaaaaaggcagagtgtcgctgtctatggtaaaataaaagcactgcttacgagcagtgtttttttctgtagaaataccagcactggttcagcagtttgatttggtaattgtccttttctaaaaacgctttttgcatttgtttcatcagccaattcggcatggctcattcctcctcagcttttagttagaggtcggttttaacacattgtatgcgaacggtgaattgtcccgttcaatgtttttaaagcggggtgcacatatggataacgaacaacttcaaaagctgacggaagacatctctgcacaggatttcggaaagccgttccgtcaccgggcctttttcaatgaccggctgaaaacgacaggcggccggtacatgctgtcttcccataacatcgaattaaaccgaaaatatctgctcgaacacggacggagcgagctggtaggcatcatcaagcacgagctgtgccattatcatcttcatcttgagggaaaagggtacaagcacagagacaaggatttcagagacctgcttcagaaagtcggagcgccaagattctgcacgccgctgcaaaccaaaaagacacaaaagaaaacatatatgtatagatgcgaggcctgcggccaacagtatataaagaagcgggcaatgaacccggaaagatatgcctgcggaaagtgcagaggaaaaatcaaaagaattttttaaaaaggcttgactcatttcaatgatctgtgttaaattataaaagtcgttgagagacaacgatgctttctcaaaaaaaataaatgttgcttattgacacaatatgtcgcatcatttataataaagaaagtctgatcattccacagtagctcagtggtagagctatcggctgttaaccgatcggtcgcaggttcgaatcctgcctgtggagccattatggagaagtactcaagtggctgaagaggcgcccctgctaagggtgtaggtcgcgtaagcggcgcgagggttcaaatccctccttctccgccagataagttctcaaccagacggcccgttggtcaagcggttaagacaccgccctttcacggcggtaacacgggttcgaatcccgtacgggtcaccatttaccttcgttgggctatagccaagcggtaaggcaacggactttgactccgtcatgcgttggttcgaatccagctagcccagccattttatttaaaaattttgaatcacttttagagcgagccattagctcagttggtagagcatctgacttttaatcagagggtcgaaggttcgagtccttcatggctcaccacttgtcacgcgggtgtggcggaattggcagacgcgctagacttaggatctagtgtcttacgacgtgggggttcgagtcccttcacccgcactttcttttcaaagtgctgatcatcatcactagcttatatgcttagtggaaagacagcttcatagcacgcggtcgtggcggaatggcagacgcgctaggttgagggcctagtgggtgaataacccgtggaggttcaagtcctctcggccgcatcccaataataccaagggtttaaccgcctttggtattttttgtgcttatttttaaatgatctactatccacaaactgcccacttacctggagtaagtcatctacagttgacgtcgcacaaatattttcatcattataggtagttactaatgcctcaaactccaatttgcaaaaggcagagaaagtattgctaagcatggaggaaaacaaagaggccttgttatattatcagctattagaatttagacacgagataatagggtaggggcataaaggtactgaaaaggcttaatcttttttaaaaggttaagtctttttttggctataaatgtaatcggtgcccaattatttgccctgaattcacgaaaaaggataaaataggtgtaaataaagttgatattttaaaattaattcaattcattatcgtaaaagcaataataactaatcggcgaagaaaggataatcagtcaaatgaaaacattagttatcgttatacaccctaatttggaaacgtctgttgtcaacaaaacctggatgaatcgtttaaagcaagagaatgacattacggttcatgacctgtacggtgaatatcctaattttatcattgatgtagaaaaagagcagcagctcctgttagatcatgagcgcatcgtttttcagttcccaatgtattggtacagcagtcccgcgttactcaaacaatgggaagatgatgtgttaacacatggttgggcttatggaactggaggtactaaattgcatggcaaagaactactcttagctatctccttaggcgcacaggaatctgattatcaagcaggcggagaatataatatcacgatcagcgagcttatcagaccgtttcaaatcactgctaactatataggaatgcgttttcttcctgcctttgcacaatatggtacacttcacctttcaaaagaagatgttaagaacagtgcggagaaattggttgactatcttaaagctgagcattgatccggtattcgcgagggaagctgaaataaactaattacagcagggcgatgagtagatatttcttgttgaaatgtagatttccttggtctctaataggtgcccagtttgtgctcggaattcatgaaaaatgatgaaaataagtataaataaaataaacagatgctttgaataaaagcttttgaaactcatgataggtttttactaggttgagggcccagcgggtgaataacccgtgaaggttcaagtcctctcgccgcatcccaatgataccaagggtaatagagagatccttggtatttttttgcgcttatttttaaatgatctactgcccacaaactgcccacttacctaaagttcaaagtgatcaaaatactcaaagtatctggacaatactttgcttggttcttatttgtcgatagtcgcagtaacgaaagcactaaacaacacattaaacagattcttttgatatgacggacacatatgacagtttgcgattgtcgaaattcaatgtataacccttgttcaacttaccaagttcagttaaaagtttgttaaaattgtgataaatgtatgaaaggattaaatgttcatgtcgaaacattaggattacagggaaggggaacaactacatgtcgatttaccataaagtaattggagatggatatccgatcgttatgttgcatggttggacacttgaccatcaggtgatgttaaatgcaatggaaccgttattcgagaaacgaagcggttggaagagaatatacatagacttaccaggtatgggacattctaagccacaaccatctattcagaactctgatgatgttttagaagcgatattgcgtcttttggacgagattattcctgatcaacagtttattgtttgcggtaattcatatggagggtacattgccagaggtatcgttcgttcacgtaaggaaacagttcgtggattactgctgatggcaccattaactatacccgaattcgatgaaagggtagtaccgcagaagactgttctaaaaagagacagcgacttgatatcacatttgtcttcagaggaggcgaatgaattttgctctatggggattgtgcaaggtaaaactgaatgggagaggtttcgggatgaaattttacttccatctaaacaaacaaattatgaattcgtaaacaacattcgtcaaaatggatatgggtttaccttcgatatttcatctaaacttgattatcccacgctaattatcacagggcgtcaggacaatgtagtcggataccatgatgcgtggcggctactcgaagattacccaagggcaacttttgcagtacttgatatggctggtcacaacctgcaaatcgaacaaaccgatgtatttaattcattggttcacaactggttaaacagacttgagtcggaaaattttcggttggtataactttccataagtataagtttactgttgcaattaccaattagttaaacaataattaagataagcaatattggggtttcctgaaattttagtaattattagtctttattgtcattggggatcatttaatcattgaacaaaaataaatccattaccttaaaaaatgttactttatttccagctggataaaaaaattttgtcaggtgtcatgcaataaattcaattgtcggtgattgactgtttaaataaaaccattatttcataccctgtgctacttatttctgttgtagtctaaggtaaagaaagttgaaaaggtatacgaaattcgtcatacaaattaaagttttgaatgaaagagcaggattactcctgctctttttctttctaattgggctagattaaacgcagacggttattccttgggaaaaacaaaaaaatttcttctatccattgactagcttggctttagcctggtttctatcaccccgttgggcttgtcaggttttaaaaaggtatgctacgtttatagtgttttgtttcacctgattgtggggtaataaagatagaatcagtaaataattcttaggaacgacctcaatcttataataaacatattggaagacgtaatggaagatctaaaataaaggtttaggctactttgaagaaataaaagttttttttcgattgtgatcatattcacaatagagctgtatgaaggggaatcatttctccaaatcgtctgcagaaaataccaaccacaacccaaggatatctcactaaccgcttaggctggtattatctgttggctgtttctctttttgttgcttcttgtattatttttagcccaatcggcaaaaataagttaaggaaaccagcgaaaacacttaatttcatccttctttcctggtttacaatgttatttggcgctgatatggatattagtctagtcttttaaggtacagttgaaccaatcagccactatgccgttagctctccatcaggtgaaacagaaacccccggacttttagagaagcattacgctatacattctgggactgcatgctcggaccgtttacgcgcttgtataatgtggatttgataattaaggagtcgatattattaaatgaagtttaacaagaaaaaaattaacgttgtagacattcaaaaagcgaagaaaagcgtgtttgctacagggataggaaacgcgatggaatggtttgattttgctttatattcttatttggcagttattattagtaaaaactttttcagtccagttcaaaacgatgaattaaagttaatatttacttttgctacatttgcaattgccttcttacttagaccggtaggcggaattatttttggtaaaatgggtgataaatttggtcggaaaatagtattaacaattactattttaatgatggctttatctactttaataattggtgtgcttcctacctatgatcagattggggtatgggcccctatattattactctttgcccgtattctgcaaggcttttctgtgggtggagagtacgctggggcaatggtatatatcgcagaatcttctccagataataaacgtataaggttaggcagcggtttagaaatcggcacattatctggttatatagtagcttctgttttagttacagtacttttctggactttatctgatgttcaaatgaatagttggggatggagaattcctttcttcttaagtattccaataggattatttggtttatatttgagaagtcatctagatgaatcaccaatctttgaaagtgacatctctgaaaaccaagaacaacaaccaggtttattagaagtcattaaaacatataaaaaagatatctttttatgtatcgtatttgtggcatttttcaatataaccaattacctattattagggtatatgccttcttatttagatgagaaccttggtataagtgataatataagtacaccggttacagcaattgtattgattattatggtaccgttcgctttaacttttggtaaactgggagataaattaggaaataaaaaagttataacaattggattagtattaggaattgtattttcaattatctcttttcaatttcttaatatggggaatataacattcttatttataggacttttaatgttaggtattgtattatctgtatacgaaggtactatgccaggatctttacctacgttgttccatactgacattagatatcgtacattatcctggacattcaacttatcagtttctatttttggcggaacaacacctttagttgcttcttggttaacccatgtgacaagaaacaatttggcgccgggtttctatttattggcagtcagtttaattggcttaatagttgtgttaaccttatttaaagatacttcaggtaaatctttaaaaggttcttacccaacagttgcttctaaagctgagtttcaagaagctgttgaaaatccaaaagattcactgtggtggaaaatggaacaaacagaaaaggaatgaaaaaaacatccatttaattgaccgactactcgaaatacagactcagaataagctgggattatccgagcagcaatgactgcagctcttttatattctggagggcttactgctttgcaaatgcagcgttgctattctcgatcgtcattattttattggttgtgtcctaataataaaacattgacgcaagaacgaagagaaattaaaaggtccgggcaatacagcaaaataagaagcaagaagctttgttatgccagttcttctcccgaaggagagctggctttttattttctgtatggggtccaaagcagaaaacgagaacttgtacgctaactaatcaacaaaggttttttggatatgaagagggtgaactggtgaaaaaacggagtttgttgtggagttagcttttcaattagggacatctcaacaacaaaataataaccagcccgattaaaaagctcatcaaaagttccattattccaatatacgatccactcaattatttgagtggatctgtttgttttttatttatttgcagcagtctctatgtgacgaaacaataaatggattaaaaccctttacgcagccaggttgcggcgagatcaattgctccgcgcgcagcttcagttttagctaaggcgttgagcatcacgaaatcgtgaatgatagcttggaaacgtacggcagtgaccgaaacaccagcttcacgaagtttattggcatatgcttctccctcgtcacgaagtacatcagcttcagctgtgataatcaatgcagatggaagcccttgaagctgctcagcagttgcacgcagaggtgatgctgtaatttcagcacgctcgttcgaattggttgtgtactgatcccaaaaccacatcatcgcgtccttgcgtaaaaagtatcctgcagcaaactggtgataggattccgtatcgaaagaagcgtctgttaccggatagaaaagtaattgttgccggatattcaagtcacctcgtgctttggccattagcgtgacagcagcagccatattgcctccaacactatcacctgcaattgttagactctcgggaatcatgccgttctcacggccattttcagatgcccacttcactactgcatagatttcttcaatggctgtcggatattttgcttctggagataaggtgtaatttggaaagacaatagcagcttgtgctccgactgctagctcacggatgagccgatcatgtgtatgctcattaccaaatacccagccggccccatgaatgtacacgatgacaggaaggtgcgcaggcgcattctgcgggcgcattattcttactgatacctgtccgctcggtcctcctgaaatcataacatcttcaatatcaactggcagtttatcaattggggcagattgaacctcatctacagcttctcgtcctttctcaggtccaaggtcgaatagatagggtgggttcgcggttgcttctgcaaattcttgagctgctttttctaattgtactttctttaacatcaatctcactccttatttgaaggctggtcacctatatgttttaatcaaatttttttattctattacctattgatcttggcatctttcgtcttacattgctgttgtaatgatttgtacatcaatatttccgcgagtagctttagaatatggacatacttgatgagctgcatgtgttaattcttccgcttgctcttgagataccccttgaatttccacctccagaacaactccgattttataaccattatcactttcatcttttaataaacttactttaccggtaacagctgattcgatttttaatcgttgtctctgggctgctaaatgaagagcactgtcataacaagctgaatagcctgccgcaaataattgttctggatttgtagccgcggatacttgatttggttttggcatagctaaatccaaatcaataataagatcattagatgttacatgaccttctcttccgccttttgttgtagcttctgctgtaaaatatactgtcatcatcaaacactcctataaattaaatttaacacaattgaattttaatcaatctaatcagcgttgtcaattaaattttttgaaattaaattgctctcaatttaaattcgcaattaaaattctctaaatgaatgattagactaaaataaagaacagttttccgcagtttaaagttagtgtacataataaccatattgagaaggtggctcaataaatctatgagtcggtctaaacaatatagtggaagtatctatatcggtcataataagaatgcacctcaaacacattttggttataaataaagtttccatgtatataagttatggttaattaaattgtcagtcattcaatttcccttaatgtaattcttatgctattatgtgtagtaatgaatataaatattgtgaggaatttaacatgaagaatgataaattactgttaagtaatcatctatgttttgcgatttatgcagcttcccgtgaaatgataaagttataccatcctctcttaaaagaattaggaattacgtatccacagtacttggttcttcttgttttatgggagaaggaaaaaatatctgttaaaggtttaggcgaagaattatatctggactccggaacattaactccagttttaaaacgacttgaggagcgaggtcttattataagagagcgttcaaaagaggatgaacgaagtgtaattattacgttaacaactgaagggaatgagtttaaagaaaaagtcacaatgatacctaatgcagtatttgataaaaccggttgtaatgaagaagaaattaaaagttataacaaggaaattcgtaatttacttcacatgctgacaactgagcaatagttttatgaatatagatggcgggccaagcgggtgaataacctgcggaggttcaagtcctctcggccgatccctatgataccaagggttttgacacccttggtattttttgtttataaaaattcatctgttactgtccacttacttatagtaggtcgtatgatttgtcagtcaccttcatccttctgctgactgcgtgcggcggtagtaaatatgataatgcaattaatgaagtgatgaagcaggagaagaaagtcagaaaagaaatgcgagcagattcagatgagtacaaaagagataacgccataatttctgtatatgatgacggcaagtatattcagcgttttatcagccagaagaaagttctcgtaggctgactgcttattcttattatgagaagcttggagattcttatgaggaaatggcacatatgccgggtgatggtgatggcgaccgccttggtctttataagaaaacacctgattataaagaggttaaaggcaaggaaacaaaaacaatgtgcttgttcattcctgataggggaacaattgttttaccgttaagttgttgtgtgagagccagtatgttaaaatgctacgtagatttaataataaagtttagattcaaggagatttatttatgaagttggatgaatttaccatcgggcaggtttttcaaactaaatcttttgaattaacaaaagagaatataatgaattttgcagaagtgtatgatccacagtacatgcatttaaatgaagaaaaagcaaaaatgggcaggtttaatggaattattgcttctggaatacaaacgttatctattacttttaagctttggattgaagaagggtgtcatgaagacgatattattgctgggacaggaatgaataatataaaattcctagcacccgtttaccctaatgataaactgaacactattgttaaggttattgataaaaaaccaaataaaagccagacggggatacttactgtattgttatctacctataatcagaaagaggaaaaagtgtttgaaggtgagttatcagtattaattaaacgctaaatgacctttgcggcatatcatcgtcacctttcattttttataggtgtctggatgaaatgagcaatcatcttaattaattgagtggattttgagtctgctctttttttatttgttcaacctatgtcgagaaacaaaggactcacaataacgaaaaaatcatctcgtaaatacgaatttaaaaattgctaccttgaggttttttgcatattcctctgtatcattgcaccggatgaatatctataatgagcgttctatccttcgatgttatgtttcctttttactttttggttttgtcagttcaaagctgtactttaccatgtcatggatttgatgctctgggagtccctcatctaaggtaagcgtattccaatgctccttgttcatatggtatccgggcttgatttcttcaaaaagaccacgcagaaaatcagccctttcaggttcgcatttaaggttgacacataagtgttcgtcgcgagtgaagataagtgcaaatattttcttattccctttgtgccgaattgcagtccaaccatctccaaaagggtggtcttcataagagtttggaaaggttaggcagtaatcttttatttcatcataattcattatcaattcactccatacctcattatttttatatacagaacatattcgttcaaactaagatttgcggtttcttttataccaatccgagatttcctcaagtctttgtttgaacttagcttctgaaccttgagttgttggatagtaatactcacgccctattaaagaatctggcatcgtgtgcattgtcgttaattttttctctttatcatgagcatttttatatcccttaccgtaatctaaatctaaaatcaatatcaattcggggctggattcaatatgatccagtccctttttgttttattgatttttcttatccccagtctgataaaagattttctgtgaatcatttaacaattatcggccgttttttctttttcgataatatcctttaccacatcctcaattgttatatgtccaagagctttttccaaggcagattgggcgatttcaaatattggaccaattgtactttgtatgttccggcctacaggacattgaggattgggattttcatgtatactaaacaattctttatcttgaacaacattaactgctctataaacatcaagtaaggtgatttcagttaaatccttcgctaattcagctcctgcaatacctggccgtacatttactaaacctgcttttttcagcatccccataatttttcttattaaggcgggatttgtatttacacttccagctaaaaattcagaagtgctaattccgtcttcatttatttcaataagagccaatatatgaattcctacagcaaaacggctgctaatagacatgatttcttcaccatcctaattactttacactctttatagtacacttgtaactgaatgtattacaagtttatttcactctaatatgctcaattaacaaggtgataaaagtattgacaaacaaataaggtgtaactaaaattattacatgtaatcaatttggttacatttaaaattttgaatgattaggaggactttaaattgaaaattggaatcattggtgcaaccggaaaagctggaagtcttatcttgaaagaagcggtaagcaggggccatgaggtaactgcaattgtaagagatgctgcaaaacttaaagaggaaaaggtttcaatcattgaaaaaaatataattgatcttacatcggatgatctaaaaaagttagatgtaatagttaatgccttcggagctccattaggagaagaacaggcacatgtagatgctggccgggcattaattagggcattaaaaggaataggtacaagagcagtaattgtaggcggagcagggagtctttatgtagacgaaaataaaactgtcagtgtaatggatacacctgatttcccggagatttttattccaacagctaaagggcaaggtcgtaacttgcaagagctaaaggaaacttctgatataaactggacatttatcagtccttcagcggtatttgacccagacgggaaaagaactgggttttatcagtcaggaaaagatcatcttcttgtgaactcgaaaggcgaaagttatatcagctatgcagactatgcaattgcagtattggatgaaatagaaaatccaaaacatataaatgaacgctttacagttgtgggagaagctgaataagttactgagtagaaacaaagggcgccattagcgtcatcgctaatggtatcttcctcctaagaatgtacggagacattgaaaactttgcaatcagagtagctgattatttttatgaaaaaggggatttatcacgttccaatgaatattatcgagctgatgacagagtaggcgcttagtgagttggatcaaaaaataaatagctctgactaaaacctttgcgggttagttagagcttttgtaaacccactcgttttcgtgagtgggctttttaaaaatacacctctcaacatgatatttattatttagtacggtaaggggtccgtcaaaacttctaatttccaaatgaaggttctcgcaaaaaaacctgccgcacgtttaacaaataaaaccctgaatgaaacatgatattaatttgcagttatttccgtttcgtgctatgataaaggagaattatttttgttcgtgtaaaggatagtatgaatatcgacttttcgtcttgatgatactttgggcaaggatagtaatacaatgtgtaatacactaggaggcaacaaaaatggaacaaggtacagttaaatggtttaatgcagaaaaaggttttggatttatcgaacgtgaaaatggagacgatgtattcgtacacttttctgcaatccaaagtgacggattcaaatctttagacgaaggtcaaaaagtaacgtttgacgttgagcaaggtgctcgtggagctcaagctgctaacgttcaaaaaactgcttaatcttcaatcgtttatacaaacaggctctttatatagggcctgtttttttatgttctctgtatcatactgaataaaaaaccctactcaccgttcgagtagggacagatgctacaaggtaagaaaaaggtttaaaacctcaaaggattgtttacagtataacataccggattgacgatatgtggaatatataaatgatttgtttttatgttctcaaggtaacggtatgttattctttgttacaattcgcatatcttttttatgaaataagataaacaactgctattcactgtcgcaagagatgtaagaaattctgaaagataaaggggagagtggttgttttttcttccggaaataatcacttagacctaaaacaatgaaagccctgcctctcttccatcgttacggctccttgtccgtgccagggtgaatcaggattacaaaaatcaagtgactatttcatcgagaattcaagtgttcgttgaagaaaaaaatataacagattagattgaggagtaataaaagcggttaatgtttaaaaagtaagttgaagaagttgaacgtctgatcgtaatactctgaaaaacttatctgtcattaaccttaacagaaactttttatttgtttttcagtgattcctttaatgacttccagttcactaatcaaaaattcatatgcattatccaacatttttttcgcttgaattaagtgctttctctttcttcatacgcattaaatcacgtacaacttcagcgccttcttgtgattaaacaggggatactaatattaactctttaaaatcattctcatgccgtcttgaaaattgacagtatacctgtaagggtataatattgattcacaaacattatctagttaataatgtagtgtgataaagcgcagtatgaaatgatagtggataacatgcaaatatataaatttcaaagaaggagttcaacgcatggaatatgatcaaaagattaaaaatcgcttacgccggatagaaggacagataaaaggtgtattgaccatgatggaacaaggaaaagattgcagagaggttgtgacccaattagctgcttcacgtaatgcgatcgatcgagcaatgggtttgattgtgagcacaaaccttgaacattgtgttcgtgaaagtttagaaaagggagaagacacacaacacttagtaaaagaagcggtcgacttattggtaaagagccgataaaaaaattcatcaacctatcatctttaaggttgacgaatttttatattcattataatatacccctaccggtatttaatatgttgaattgaataataggagatctttcgaaaaaatttttaatttcaatatacccccaggggtaatagtgattggtcaggagaataaacatgacaaaacaaacaaaacgcacaacaattgttttatttagcggggaatatgataaagcaatggcagcctatattattgcaaatggtgctgctgcctacgatcatgaagtgacgatcttccatactttttggggattaaacgctttacgtaaagaagagctgattccagtgaaaaaaggatttcttgaaaaaatgtttggaaagatgatgcctcgcggtgccgataagatgggtttatctaaaatgaactttgcaggtatgggccctaaaatgattaaaaatgtgatgaaaaagcataatgcacttacgttgcctcagttgattgagatggctcaagaacaaggtgtaaagctcgtagcttgtacgatgacaatggatcttcttggtttacaggaaaaagaactattagatgatatcgactatgctggtgtagctgcttatttggcagacgctgaggaaggcaatgtcaacttatttatctaatgtgatccattgcaattgaataagtgaaggggggatataacactatgaatagcggagtaatgttcaatactttggatcgtatttcgacgttttttcccattgcatggtgttaaacaaataacaactgctgatttaaaatcggaggcggaaaacaaagacaaacagtttatagatgtgcgaacttcttatgagttccgtacaaggcatattaaaggattcaaaaatattcctttgtctatcttgcctcgtcaaactcatcaactttcgaaagacaaagacgtctttgtgatctgtcaaagcggaatgagaagtgtaaaggcaagtaaaatattgaagaaacaagggtttaaaaacatcacaaatataaaaggcggtatgaatacatggtattaacatccagggaataactttttgcatatttatatacccccgccctatataagaaaaggaggaaaaaaaccgtgaaagcaaatattgtattagacgctaaaggtttgtcatgcccaatgcctatcgtaaaaacaaagaagaaaataaaagaattaaaagctggtgacctattagaaattcaagcaacagataaaggatcggcggcagatctgcaagcatgggcaaaaagctcaggccatgaatatctaggtactgaaacagagggagaagtccttcgtcactttcttcgaaaaggaggagagcattcatcagaaaatgcatcttcaattcctgagatttcattagaagctttcacacagaaagtggatcgtgatgagtctcttcacattttagatgtacgagagatagaggagtatgaagaagctcatatccccggagcggtgcatatccctcttggcgaagtggaaaagcgctttaacgaattaaacaaaaatgatgaaatttatattatttgccattcaggaagaagaagtgaaatggcagctcacaccatgaaaaaacaaggttttaaaaaggttattaatgttattcccggtatgcgggactggacaggtaaaacagaaaaaggaggtatgtaaacatgaccgtgcaagcacttaccgcaaaagaagtcacacaaaaaatctttcacaaagaacctttatttattttggatgtacgtaatgaaaatgactttagcgattggaagattgaaggacatgattttaaccatttaaatgtaccgtatttcgatcttttagatggcgtagaagatatcttggagaaaattccttctgataaagatgtgctggtcgtttgtgcaaaagaaggttcatctgtcatggtatccgaaatgctttctgaagcaggtcattctgtatcctatcttaagggcggaatgaaagcatggagcgaacatttagagccggtaaaagtcggggatttaaaagatggcggtgagatgtatcagtttgttcgaatcggtaaaggctgcctatcatacatggtcatttccaatggtgaagcggcgattattgatgcgacgcgtatggtagatttctttatggattttgcgaaggagaagagtgcgacgattactcacgtatttgatacacatcttcacgcggaccatatttcaggcggcagagtcattgctgaaaaaacaaaagcagcctactggttaccgcctaaagatgctgaagaagcggtattcgattatcagccgttggaagaaggaaacgacatgaccatcggaaatacaaagattaaaattcaaccgatttattctccggggcacacgattggttccacttctttcattgtcgatgatcagtatcttctttcaggtgatatcttgtttattgattcaattggcagaccagacttagccggtatggcagaagattgggcaggagatttaagaacaacgctttatagccgttacaaagcgttgtcacaggatttaattgtattaccggcacactttatgatcattgacgagctaaataaggatggaagtgttggtaaaaaactaagtacattatttagcgagaaccatggtttgaacattgcggatgaaacagaattcagacacttagtaacagatcatttgcctccgcagccaaatgcataccaagagattcgagaaacaaacatggggaaaatcagcccagatgaagaaaaacagcgtgaaatggagattggtccaaaccgctgtgcaatacggtaactcaagtttctattaaaaagaggagagatgaacatgaaatcagataaagtattagacgcaaaaggtctggcatgcccaatgccaatcgtcagaacaaagaaagcgatgaatgaactggaatcaggtcaaatattagaagtgcatgcaacagataagggagctaaaaatgatcttgcagcttggtctaaatcaggcgggcatgatcttttagagcaaactgatgaaggcgatgtattaaaattctggattaaaaaaagctaatgaatgtgaaagggtatcgaatacaaagatgccctttttctttgaaaggaggaaccaaaatggatattgcttttatcacaactcttttcattatagggtttattggtgcctttatttccggaatgatgggtattggcggatcagttattaattatccaatgctattatacattccttctttagtgggagtgatgtcattaactgcccatgaagtttcagggataggggctattcaagttttctttgcgacacttgggggtgtttgggcttatcgtaaaagtggttttttaaataaagcattaattatgtacatgggaagcagcatccttttagggagtgtattggggagttacttttctcattatatatctgaaaaaggaattaactttatatacggaattctggctatactagcagttattttaatgtttatacctaaaaaaggacaagaacatagcgaagacgaagaagtgatatctaataaatggttggcttcgtccctagcgtttctcattggcggcgtatcaggtattttaggagctggcggcgcctttatcctggttcccattatgttatcgattttaaatatccctgttagaatcacagtcgcttcatctcttgcgattacatttctttcatctattggcgcaacagttggaaaagtaatcacgggccaggttctttttacaccggctctggttcttatgattgccagtttgattgcttctcctattggcgcatctgttgggcaaaaagcaaatacaaaattcctgcaatggattttagcgctattaataagtgcgacagctattaaaatttggttaaagctcctttgatatgagtcagcgggtaaaatgaaagattaaaagattcatcacccgttggtttcttattaattctttttgataatggtgacttgggcaagtcttgactatagtaccgtgaaaaacatttgacttagttgcgtccagtatttttttgcatttaggacagcgttttggaacactataaacctgtacgttttaaaacgaagatggtgattttaacaaacatggcacccaagacatgtcatgtaactttctggtgatgaaaaaaacgactccatttttactccacaatatgaattaatctttgtaaaataacatgatcaatataaacacacactaatatataaaggttttgtaatagaaaacacagtttcactttattgatggcccagcgggtgaataacccattgaggttcaagtcctctcagccgcatcacaatgataccaagggttctgaggtttttggtattttttgtttgcggctgcgccgttacttaaagcaagtcgtctggtttgccagctatcttttttaaagccctttttcaattaatgaaatgataaaataggagaagaaagccagaaaagaaatgagagcagattcagatgagaaacacaagaataactcatcgtgatcgtattcgtacacatttttacagaggaggacaattatgattggaatactggcaggaatggggccaaaatctactgggccatttgtagataaagtcgtagacgagtgccaaaaaatatatggagcaatacatgacacggattttccacatatgatgatttattcctgtccgacacctttctacatgaataaacctctcaatcatacggacatggaaaatgcaattattaagggtgctgtaaagcttgaaaaaacgggtgttgattttattgccatcccatgtaataccgcacatctctattttaatcaaataaaaaaatcgatttcagtccctttactgaacatgattgatgaaaccataaaaaaaatacctaaaggctcaaaaaaagcagctcttttagccaccgttcctacggttcaatccggaatatttcaagaagcgttaaacagagaaggttatgattttttacatcaagatagttggcaaatctatgtcgatcaaataatagaaaaaattaaacaaggtcaaatcgatgaggctggtacattatatgatgaattacaccatgacttagcagaaaaggctgatacggttatcattgcatgtacggatttaaatatggtcacggaccaaaaaagaagcggacttactattgttgattcatcagcctgtctcgctcaagccattgtaaataagtatgtatcattaacaaaataagtcatctgatttatcagcaaattcagggcgctttttttcctttaaagcgcccggcttcggcagatgcatgatcctcaattacttctttgaatgtaacttccccgtgttattgttcttttaacattgaatactttcgatacgttttatagaaactgcagccaaatagaacagccataagggcgggaagcgacctcaacagggcaaatggagtttcaaataaaaatgctttccaaaacattgcgctttccatactccacagaccttcagttaaatataaacccgaatccttgtaaatcaaataagaataaaacaagcacagtaaaccaaaacaagatgaaaaccccattagtcttttataataattactctttgattggcgatccgaaaagatttcattttgatcatcattttctttttgccaataccgagttccgctaagccatgggctgtttatataaacccagccgaagtcttcatagatttctttgtactctttaaattttttctttgataaacaatcttgataatccagtctcatcacatattttttgtcggttttttcgaaagtgtatattcctaatccgctgatatttgtacagcgatagcctttttgtagttgctcgttcagccattgctcctctttttcaatatcaaaaaacatcttaaatttcttcattcgattcacttccttcgtgcagggataaaatatgcagtaacctgttttgttccatcttcaaaatggcgcttccttccgcagttatcatataaacctttctccggcctgattctccaacaggctcaatccagccatgcttattcaaattttcaatcgcgccgtataatgtgccggctgctaaaataacagttccgttactcatcttttctatcttctgcatggcggcatagccatgaagcggctcacgcagagctaataaaatataatgcatggtttcagacagcggtaataatttatgtttcatatcctcatcctctattcagttcgactatatagttaaacttaatacagtacaactgaatagtcaatggccttttcaaaatttgtaaaaggaacttgaaaatcaaatctaaaagtcgctttctttacgtaatgggaagcgacttctggggcagttctattcaataaatggcccgattgaacgcattaaaaataccaagggtttgagtcccttggtattttttgttcattgtatgatgatgtaaacttcttgcttatttagcgctgtcgttccagtttttctctataaatgtattcgcaggctgtaagttggttttgtttgcaatttcaatgacagcgggaaccacggaagggtctgttttggagaagttaggaatccgcggatctaaccggaaaaagcgatctcccagcagattcgcgctgaccatggattcatagtagccatttccgccggagatcatctgaagaaatggcagtaaaggttcattaggcgacctgtccaaaaggactccccaatttggaggaaggttcttcagattttcgggacgtatgttatccgcacttaccattccccatcccctcgtatctcttcttaaccgagtcggggcttcacctgtaccgatggatagcgccgcaatttgatccaatggcacgttggctttaccaaccgcaaacgcgatactggccgtactggggttcgttgccactacatatccgtccacgtagttttgataggcgcgctgtgtcgcgggagcaccgctgctccgcagtatgacatcactcactttctcatttaaatagggagagccgggaaagttgtgaaataatacgggcgtccaacgatccagtgccggggagtataatttgaatgaagggacaacaattcgttttcttacatctttaagacgaaggcctggcgggaaaaagtttcgtaccgctttaataaaaccggaatagggtaattgctgattaaaaacaggtccgcccggccgggaagtgctgaatgcgggcaggatttcatcctcaaaatactgaagtgtttccttcggagatcttccgcttgctaatgccagggcagtaaatgaaccgattgaatttcccgcaaatacatgggttcggcttattaatgccggattttcttcagccagtctgttcaatagttgtaaacttaaagcacctaaggtaccgcccccgtcaaaggtcatgatccgatattttgccaaagctgatttctcctttctgatgaaaactatcattcagtatatgttcagccagagtctattgtatggatgaatgaatatctccttatcttaaaaatagtttgattatcaatccggcgagtcgggaaaggatatgttttttatttgaagaggttttttccgggaagaaggagaattattatttaaaaataaaagggggaaaatacttgaatacaattgaccttattgttttacattttgaagaggtaagacggcgaagcatcaagttatggacagctgtacctgaggaaaaaatggactggcgcccggactccgaagccatgtcgtgcaaggaaatgataagacatgtattagaagcggaatttctttatcatcaaattttaatgaaaaatatgagtgagttttcagaggaaactattaatccttatgaatcaaaaacgtttaccacagtaagcgaagaattagaatttgcaaaaccgtatcgggccgcgtttttgacattcatcaaatcgttaaacgaaacagatttaacaaatataaagattgacaggtctgatgttggatatattcgcgaactgggagacatgttattaagaatcgcttaccatgagtctgtacataccggtcagcttttagactacctcagaactgctgaggttgacaggcctttaatttgggactagttaaatgattgagttttacacgggaaggggaaagaatggaatataaaccgattaatttccaagagaaattatctgcattccaagatcaatggtctccaaaagtaatcgctgaaatgaatgattatcaattttaaacttgttaaagtacaaggggattttgtttggcataagcatgacgaaacagatgaagtctttattgttattaagggtaatttaatcattgaatttcgtgatggaaaagtaaaattaaatgaaggtgaaatgtttgtcattccgaaaaatgttgaacataaaccttatgcagaatcagagtgtaacattttgcttgcagaacctaaaggtgttgtcaataccgggcaggaaataactgatcaaacagctgaaaatgatgtctgggtctagcctgtaacaaaaaaacgatcaaaactccgaaagatcgaatgacgattagagaaaatgatcaggaaaaccacttaagaataatttaaggttaaatattgaaaaaatttgttaatattataatatattgtttggaaatgtaatcttttataaggagttttctaattgcgttggagtaaatggttcaatattttttgcatagcagcattgggatcaatatatggctataaattgtttactaatcaagaagtcagtacggctcgtgtaatcatagctgctgctattatcttgtggaacattgtcggactttttagcaaagaaccagtaaaacaaacacagcaagcaaactaaaagctaaaaaatactttccaatcgttcaataaaaagttggtacagaaggatgctgcagcgtgcagcatcctttttatcatttttacaaaaaaaccaagggtttaaccccttggttttttcgtagtctccctttttacgctgcttaagataatcgtcaaaatcattcaagtttcatgcaggcatccagattctgttgcaatgataaatgaaaattgccctaaaaatgtgccggttcatcaaaataccagtccaagctgcagatctttctttacatagtatgtagagattaaaaaatgagagaaggagtggcgtaatgtattataacgatggtgacgatcaacagtacttccagaagaaaaagccatacaacgaggcctgtgaccttggccatgattttgatatggcggacgacgatgcaagagcggaagcggcaagagaagcagaagcgagagccagagcggaagaagccatagcaagagcggaagaagcaagagccagagcggcagaagcagcaaaagcagcagctgaagcaaaggtagaagcggcaaaattagcagccaaagcaaaagcgaaatgtaaaaaacgtcataagaaagagaaaaaacatgattgcaaacgtaagcacaagaagaaaaaataagagcttttcatcatgtaaaagataagattcaatgtgtattgattttatccgtacaggggtgcaaaaacgataaagaaaaagattcttgtcgggggatcaaacagaaagattgctcagcagaaccacgcatggcagggcaaacataatgttctatggacttccatagtttggtcgggatatcacgccaataaatgtaagtgcctatcatggcaggagagacaagagtttcggcaggttgccgcacttgtcttttttttgttttttctcatcttcgcgtatatgtatctatttttaagtttgcagaacatctgtctaagaatttgtccaattcctacatatactggtatgggaatcaaatgcttattgggagtgaaatagatgggatcagcacagttaacgggacgtgtcatcttcaaaggggaccccggctatacagaggcggttaagaattggaacccttatgttgatgtctgtccgcttgtctttgtttttgcgcaaaattcatacgatgtaagtaatgctattaaatgggctcgtgagaagaatgtgcctttgcgtgtcagaagcggccgccatgctctggataaaaatctttccacggtaagtgatgggattgttattgatgtgagtgacatgaataacgttttcttagatgaaaaaaacgcggtggcaaccgttcaaaccggcattcacgtcggcccgcttgtaaaaggtttagctcgggaaggttttatggccccgttcggagacagtccaaccgtcggaatcggaggaatcacgatgggaggcggatttggagtgctttcacgatcgatcggcctgataagtgataaccttctcgcactgaaaatggtagatgccaaaggcaggatcattcaagcaaatcattcccgcaatgaagatttactgtgggcttccagaggcggcggaggaggcaatttcggatataacacccaatatacgttcaaagttcaccgtgcccctaaaaccgcaaccgtctttaatattatttggccgtgggaacagttagaaacggtattcaaagcatggcaaaaatgggcaccgtttacagacgaacgattaggatgctaccttgagatttacagcaaagtaaatggtttgtgccatgcggaaggattgttcctcgggtcaaaaccggagctgattcaattattaaaacctttattaaatgccggaacgccggcacaaacagtaatcaaaacactatactatccggattgtatagatttcttagatcctgatgaaccgattcccggcaggtctgatcagagtgttaaattctcctcggcgtgggcgctcaatctttggccggaagaacctattgcagtaatgagacaatttttagaaaaagcgactgggacagaaaccaatttcttttttatcaattggggcggtgcgataagcagagttccaagcagtgaaacagccttctattggcgccgtccgttattttatacggaatggacggccagttggaaaaataaatcacaagaagcttcgaatcttgcatcagttgaaagagtgcgtcagctgatgaaaccatatgtaacaggttcttatgtgaatgttccggatcaaaatatcgagaacttcggaaaagcatattacggctcaaactttgcaaggcttcaaagaataaaggcgaaatacgatcccgaaaatgtattccgttttccgcaaagcatcccgccatcgtataaatagtttgatcgttgtgggaaacaaaataaaaaacacaccagaacattcaggtgtgtttttattgttgctataaaagttggttattcacttatattcccagtgcggattccaaacaatttcccacaagtgcccgtcggaatcttggaagtgaccggcgtatccgccccaaaaagtatcatgagcgggagcagttatcgtaacgtttgattcatgtgcgatgtctttgcggtcccagagggcaagtttcagtcccgtttgcaagtcgtccaaatctgtaccggctgttccttctgtattctgtaggcagacccaagccatcccgatagaagtgcagcgatttttctaaattatctgcgcctaaagtaattactgtaatccgcggcttcatagcaatgcaacctcccaagctaagctaatgataagaaacattttcattgaaaatattttgacatttcagtaaagaacctatatattcatatatgagcacataatcatataaggttatttttgtgtccgtgttagaatgcttcatagcagaaaagaaataataaatacagtgtattagataaggaggagatttttatgggtcacaatcacaatcacgctggcggatccaataagaaggttttattgatctcttttatcatgattacaggttatatgataatagaagcgataggcggatttttaaccaatagtttagcgcttttgtcagatgcaggccatatgctgagtgattcaatctcattaatggttgctctgattgcttttaaattggccgaaaaaaaggcaagtcatcataagacattcggctacaaacgatttgaaattcttgcagctgtgatcaacggtgttgcattaatactgatttccctttatatcatttatgaagcaatcaaacgtttctctcatccgccggagatagcaacaaccggcatgctgacgataagtatcatcgggttagctgtgaatatattggtcgcttggattatgctgaacggcggagatacaaagaataacctgaacattagaggagcttacttacatgtgataagtgacatgctcggatctgtaggtgccatactggctgcgatccttatcatcttcttcgggtggagctgggcagatccagtggccagtgtcattgtggctattcttgtgctgagaagcggttaccatgtgacgaaagactccattcacgtattaatggaaggaactccggaaaatatcgatgtcactgacatcattcatacaattgaagagacagaaggaattcaaagcattcatgatttgcacatatggtctatcacaagcggattgaatgctctttcctgccacgctgttgttaacgatcagctgaccatttctgaaagtgaaagtattttacgcaaaattgaacatgaacttggagatcaaggcattacacatgtaaccattcaaatggaaacggcagcgcataatcacgacaatacgattctttgtcaggcccaaactgagaatccgcgtgaccatcatcatcattaaaggaggagatagggactaactttgtctgctgacaattaagataaaaccggagggggattcatatgtacgacacgatagtaatcggagccggtcaggcaggaatctcagtaggatattatctaaggaagtcgaaacaaaagtttatcattttagataaaagtcatgaagtgggggaaagctggaaaaaccggtatgactcattggtcttatttacttctcgaatgtacagctctttgccgggaatgcagcttgaaggagacaagcatggactcccttcaaaaaatgaaattgctgcttatctgaaaaaatatgttgaaagatttgaaatcccgatccaattacggacagaagtaataagtgtccaaaaattaaacaactatttcttaattaaaacaaaccgggaagaatatcaaacgaagaatctggtggtggccgcaggtccttttcatacccctaacattccatcaatatcaaaggatgtagccggtcatattcgtcaattacattcttcacaatataaacattcaaaacaactggcgcctgggaatgtactggtagtcggcggcgggaatagcggggctcagatagctgttgagttatccaaagaaagagttacatatttggcttgcagtaaaaaaccggtttatttccctttatggattggaaaaagaagcatcttttggtggtttgataaattaggagttttacatgcaagtcatacatcaatattaggcaagttcattcaaaagaaaggcgacctcatatttgggtatgaattaaaacatgcaataagacagaagaagatcatcttaaaacaaagagtcatagccggaaagcaaaatgaagtcatttttaaagattcatcttcattagaagtaaacaatgttatttgggcaactggttttaagaatccgctttggtggatgaaaatagaaggtgttttggataaggaaggccgaattatacatcaccggggtgtttcagctgcggagggattgtactttattggtttgccttggcagcataggcgaggttcagcgctgcttcaaggtgtaggaaatgatgctgaatacattgtaaaacaaatgaacggcggatagactgaggagagcagtaacttacgtgtttactgctcttttttgtgttgaatacgtccatcagtgcaactattttagtccgcgcatattcagtttgaactaaatggattcacatggagcgcgtgcttcactcctcgttcagactctctaatttaattctttcaagtaaaagtcgaaatagctcaaataacaagaagttaaaaaactgcaaaccccgccgtatacgtatccgcccactatagagttcattaattacttgggaccatagaagaattgtcaatgccacttccgatagttgtaaccagccaaaaaaagaaaatggggagggtgtgcttaatttgcacaatcttttatgtagaagtggcccaaggagccatcctgcattttgcattcgaatgaacctgtcgtaaaaaattgagagcagacttaaatatctgctcaactcgctgttatttctcaatgttgaatcggtctttgatcttttcaggcagtttctcggccttaatagcttcagattctccggtataaccctcatagctcctcggaacgcgtacaatgtcaccttcttgataaggcttttcaacaaagaaagaaaccatctttttcttacctttctcgttatacccttctaaattgtaaacgtagttgctattatttttgtttttttccgcttttccgtgaatttgtacgtaataatcgctttccagcacggcgccttgatcagcgcagcctcctaatatgaaaaccgataggcagcctaatataataatgaaaatgctcatgtttttcattcttcatcactccttttatatttcttattctaatgaacactgcatatcgaataaatgcgaataccttacacttaccttacttttttgtaagaattcctgatataaaagataatgattcagttgcagaataacaaataatgggtaaatgcaatctcgtttggaaggagactgatatgatcattaaaatgactccattttttaatatgaaagaattcaataaaccaaacaaccatttgctgtttcaaggagaattgcacctgcatttgaaagcaatgtgtggaatataccgaggaacgatttgctgaaccttatgttaagaaaaatgaagatgatgatgtcagttacgttgaagaagaggggaaagcggtctttttttattacaactgcgccggccggattaagatacgttgcaaatgtaatagcgatttttgtctgaccattttaattgattggcagtcagtgaaaatagacatttgtaatgaatttatcgttgctcctcctaataagcggctttaactgccaagtttctgtttctcttcataccatttgcgaagctgatgaatatgagcttgatgatatctattatggtctgccatatgccatattccccattgaatggttgatgatttggtcctttataatcaatctcctgctgtgacatgtctgacacaatggatattaagcggctgtcattttcattaacggcagaatacagcgttcccacaagatgatccatgtgcgtttcaccttttaaatctaaaatcattaaccccacctcattagcacaatttttatatcagtttgccttattactcatatttgtcaagccatccggggaatgggccgctgtaagacgaagctatgaagcaggctctctttgcctgctttttttgtgtgtcggctttacatctgacatgttgcgttatctgaaactgtacctttttaaatgtcagacagtgttatatgatactctgcagatattcaagaatatgtacttggaggacattctcatgcgaaattttaatgttgctatccctacgccttttcatgaagatgaaagtttatatttagaaggatttgatgctattgtcgaacatttgaaaaacagcggtatccattcgttactcatatgcggcacgactggtgaacagcattcactcagcatagatgagcgtcttcagatcattgagtatgttaatcagcgaaaatttgaagatgttgaactgatgttcggtgtttcagccgtaagaaccagtgatgccgtcaaactgatgaaacacatcgagaaaaccaatattgattctgtactgattggttttcctccttatataagaccgacacagcagcaagccgtttattacgttgacgaacttctcagtcatacctctaaagaggctgtgctttataataaccccggccggaccggttttaatctgagtgagaaagcgcttaaagacttaataagccggcatcccgggataagggggctgaaagaaggaggagacgttctgcgtcataaacaaacagagttccctgatcactttattttgtttgcggcaggagacgttgaatttccgaagatgctgagtaacgggtgtaacggcctgtcaagcatggccggaaatgtctatcctgaagaaatcagagaaagcttcagcagcttatcagaaaataaaccgattaatctggatcgaataaacgatctgattgctgaagtgacaaatcatcatactgtcatgaatataaaaaatcactataagaagattgggattcaagcaggcagctgccggtcacccattatataagaaatgttccgtcgcggataagtgaaacatgtgatcagcgcgctttctgtacttggattaggcttaataagcaagttttataatactgtcattagcgggggcgtaagcatttgtttaactttacataagggaacccttatgatatggtgattattgttaatattgacaagaaagaggtgaaagcgatgataacgatttatggaattttgtatggtgaaaatgcaaaaattggaaacatcttggcggataaagggagcagtctgtccttttttaagccaaatcatcatacaaaaacagttatcggtgctttttctctatgtcaaataaacgataatccaatgacataatgtccttgtttatttgtgcatgatgttatttaagcgtaacaccgataattgtgtcggtgtttttttgtgcctgattttaaaaaaaggttagatgatcactcccttctatttactcaaacaaaccagagttttatggaaggatgagaaaacatgcaacaaaaaaacaagtatataagaattcaagagttcctgaaacaaaataagtttcctgattttagaatgaatcaaatcaaaaatgctgtgttcaaagggagaataaatcattttaatgaaataacggttcttcctaaatccttgagaaaattgttaatgaatgagtttggagagtcaattttaaatattgctgctttaaaagtgcagcattctgagcaagtaacaaaagtcttatttgaaatttcaggagacgaaaaaatagaaacggtcaatatgaaatataaagctggctgggagtcattttgtatatcctcgcagtgcggctgtcattttggctgtgcattttgtgcaacaggagatattggtttaaaacgcagcttaacatcagatgaaatgactgaccaaattttgtactttcacttaaaaggacattcaattgatagtatttcttttatgggaatgggagaagcattagcgaatgtacaagtttttgatgctttacatgtgcttacaaatccggagttgtttgctttaagccctcgtcggttatctatttcgaccataggtattattccgggcattaaaaaaatcactcaggattatccgcaggtcaacctgacgttttcattacattctccttttaatgaacagcgaagcaagttaatgccgataaatgaacgcttcccgttattggaggtaatggacacattagatgagcatatacgtgtgacctcaagaaaagtttatattgcttatattatgctgccgggagttaatgattctattgatcatgcgaatgaagtagtacgtcttttaagaagcagatataagagagggaacttgttccatgtaaacatcattagatataacccgactgttagttcacctatgagatttgaagaagtaaatgagaaacaagttgtaaacttctataaaaaattaaagtcagcaggaattaacgtgaccgtcagaagtcaatttggcattgatatagatgctgcttgcggacaattatatggaaattatcaaaaaaataagaaccgataaatcaggtgcagaactcggtttgacttcatattatttcatttgataacataaaatggttattgtgattgaaaaaaagatacccgtttttataaaaaaggagtcataacgttgctgaaaaggttttttcttgtttttcttacgctgatgatgtctatatttgctgtattcgcggcggctgaagagtctcccggcaatcgtgtcatttcttttgacgagcctatgattttattgatctcactcggaatcattttatgtttgttcattccgccattcgtcatgtccttttttagcagcttggttgtgagaatcatatccggagtctatcaatgttttatcgttctcacgtttgcgggcctcattccgattggatttctgattcccaatggctttttgacaattcttgctgccgttctggggactttggtcagttcagcgagtgttgcggtcaccttattcgttggcaggacagagaacacaaataagctttcgtaagcggttttgacaacaataacacgtcctgaaaacaccaagtgtcacagacccttggtgttttttaattccggcagaaaagaaggtataatgggcggggaagaggtgtcagccaatgaaaataaccagagagacattagaaaaacagcaaatttggatatatggtgtgactcttgtgatcggaggaatagcggggatcgccgggaaagattcaggacttcgctggggatggacgatatcactgtttatcgctgttctcatgtatgccatgtttgcccaaatcccattcttgaagctgagggaagccatgtcaaacctcaagtttatggcggccttactgatcggtaatttcttagctgtacctgtcgttgtatgggtgttaaccgccatttttcctcaatctcctcctatattatcaggggtttgtttggtattgcttacaccttgtattgattacgtcatcgtctttactcagctcggcaaaggaaatgagagattaatactggcttccacgccggttttgttcgccgttcagatggtattgcttccgttatacctgtggctgtttatcgggaaagaagtgataggagctgttcatgcgggaccgtttctggaagcattcttattgttaatagcggtgccgctgctggcggcggtgatgactcaattatgggctgataagaaaccggcgggagaaaaggtgttggaatggacggcgtggctgcctgttccttttatggctctggttttattggcggtcgtcgccacacaaatcggcaaagtcatcaatgatgctgacatcattatacgtgtgattccgatctatctgctattcctgctcattatgccgtttgtctcccgttttatcgcatatgcgttccgtctggatacaggtgaaggaagagcattgatcttcagcacgggcacaaggaattctctcgcagtccttccgttagcgctggctttgccggatgcttgggcctcattagccgctgctgttatcgtcacacagacgattgttgagctgatcggtgaattggtttatatcaaagcggtgcccggatggctgctgaaataaaaaataatctgggctgaaaaaaacataccaatagatattggtatgttttttatgagaattataaagttgcaatatcaataacgaaacggtagcggacatcgctttggagaacccgttcgtacgcttcgtcgacttgatcggccggtatcacttcaattttaggagcaatgccgtgctcggcggcgaaatcaagcatctcctgagtctgcggaataccgccgacgagtgaacccgcaatgctgcggcggcccgtgattaaggagaacacactgtatgagtccggcttagcgggcgctcccacatttaccaatgtaccgtcaatgcgaagcagggataagtaggcatctacgtcaaggttcgcggatactgtatttaaaataagatcaaatcgtccggccagctcagtaaatgtatccggatcgcttgtcgcaaagtaatgatcggctccaaattcaagcgcttcgtcttttttgttcattgagcggctgaggacggtgacctctgcgcctaaagcgtgcgcgaattgaacggctaaatgtccgagcccgcccattccgacaatcgccacttttttgccgggaccggcattccagtgtttcagcggagaataggtggtaatgcccgcgcacaatagcggactggcagcatccaaatccagctgatcgggaatacggacaacgaatctgtcagtgacaactattttctggctgtagcctccgtacgtagggtttccgtcgtagtccaggttattataggtctgaacaacgccttttgtgcaatattgttcgtctccgttcaggcagtattcacattccccgcaggagtctacaaaacagccgacacccacacggtcgccggcggcaaatgtggtgacttcttcacccacggcttccacaactccggcaatttcgtgcccgggaaccatcggaaagattccgccgccccattcatcgaatgcgctgtggatgtctgagtgacaaatcccgctgtacttaatatcaatcaggatatcgtgcggccgtaatgctcttctctcaatcgtcgtccgctcaaatttagctttggcatgcggagcgcttaatacacgagtcggatgattattgcacatggttatcttcctttccaagataaagtgatgaatcctctgttcggttttactttaaatgttaaagcggactttaagtcaaggggtttggtttatttttttatgaaatgatattctataatggcacgcttatgaaaggtatgaaggatgggtggtaagaatatgaagattgcgcaggctgcaaagcaggttgagttatcagccgcgacgcttaggtattatgaaagtataggactgattcctccggtaaaacgcgatgaaagcggcatccgcgattatgacgaagatgatgtgaattggattcaatttataaaatgcatgagaagtgccgggctgtcgattgaggcgctgattgaatataccgctttatttattgaaggagccgatcatacgatcgaaccccgaaaaaacatccttataaatgaaaggaaaaggctgacggagaaacagagggaaattgatgaaaccataaaacgattaaacaggaagattgaggattacgaagatatcctggaaaatgaagcgaaacttaaaaacagattgaaagctgaatgtatttctgaatgaagagaaggtgtcccgggcgccgggccgcatgaaatgtaccaagggaaacgagccttggttttttttattttctaaagagaggaaacaaaacagctttttctatcttatcaatcattacttatccttttttcagcttgacttttttactgcagacttttaaagtgtgaaatgttgcttagactgtgattagcgactttaatgctgaaaagaggtggtttacccagatgaacaatcataagaatccttgggcgttattgcctttagtcttattcgtagggctttttgtcggctctggtctggtgaccggagatttttataaattgccgatcttgattgccgcgatcattgcgtcagcttttgcgctgttatttaaccggaagaaatcgctcaatcaaaaaatagaatggttcgcttccggtgcgggacatcctgatattatcattatggttatgatttttatattggcaggtgcctttgcttcagcggctgaggcgatgggagcggtgcattcaactgtcaatcttgctttgagcattattccgcagcagtttttgctgccggggctgtttatcattgcttgtttcatttctatatcgatgggaacatcaatgggcacgattgcggcggttgcgccgatcagcgccggtttgagcggagagcttggcatctccagcgcgataccgattgcggctgtggtcggcggagctatgttcggagataatctttcttttatttcagatacgaccattgcggcagtccggacgcaaaaaacacaaatgagggataaattcaaaacgaactttctgattgttttgcccgctgccattgtgactgttattatcttattttttattccggcaggccacgccctccatacggatgctgcatcttacagctggattaaggtgcttccttatgtcgccgtgttagtttttgcgttaatcggtattaatgtgatggctgtcatattcggcggattggttttgacgggaatcatcggattggcgggcgggagcctgacgtttgattcttattttaaagcgattacggatggagttgccggaatgagcgaccttatcatcctgtccatgctgatcggcggaatggtcggtgtgatgaaacaaaacggcgggatcgactttttactggagttcatcacgaaacgaatccgttccaaaaaaggcgccgaagccggcattgccggattggtcagcgtgacgaatctggctgcggccaataatacgatctcgattatcgcagccgggccgattgcaaagaatattgctgataaattcaacatcgacaacagaaaatcggcaagtattctggatatcttttcgtgtatgatacaaggattgattccttacggcgcgcagctgttatcagccgggaaattcgggaatatttcacccgtcagcatcctgccatactctttctatcccgttttaatcggaatctgcggcatcgccgccattatatttggactgccgaaattcccaagaaatacgaaataaaagataaaaaaaggcgccgttcggcgccttttttctttcatgacagccaagcatttctcaaaagctgtacgccttgtgtgatctgatccgtatcgagatgggcgaaacctaactttatgatcggcggttcgggctttccggcaacgaaatagacagcggtagggtatactttcactccgtactgaaaggcgcgttcgattaatgtttcttctgtatagttcaggtgaactcttactaatatatacaatcccgactgctcgccgatgatcgtcacctgatcgccgaactgctgcttgatatgtgaagtcaagtgctgcatcttacgcttgtagacagtgcgcatgcgcttaatatggcgggtccattcaccggccttcatcaattcagccatggtcagctggttaagcgaagaagcggtgctttcgaaatgaataaaccgttttttataccggtgcaaaaggcgctgcggcaaaaccatatagcttatgcggatgcccggtagaaaggattttgagaaattccctaaataaatcacccggtctgattgaatggaagcaagagcgggaaacggctgctgtgtataacggaattcactgtcataatcatcttcaagaatataaccctctctatgattcacccaattgatcagtgtttggcgctgctgaatggacatgcttacgccgtaagggctgtgatgggatggggtcacatagattaatttttctttcattgcatgcaattgagaaaaatcagctccgttttcatagacaggcatcgtttccagagatagcccgtgaaattgaaatgccgctctggcaccgtcaaacccagggtcttcaacgataattccggaaaaatcctctttcagaatctggctgagatatatcagcatctgctgggtgctgctgccgatgataaccgaatccgcatctgttttcactccgcgtgattccaagagataagcggcaatttgttcacgcaggtttctctcgccgaacggttcaccgtacagaaagcttttctctgatgccaaaacttgattgtataattttctccatgttttcagaggaaaatgcttttgatcgacggctccggcgcgaaaatcaatcagggccggctgagttgattcggttttctcagcgtaaacaacatcatgttcttgttgaaataaagagggttctatttcattagcaaaatatcctttgcgtgtttctccgcgaatgtatccctccgctaaaagcagatcataggccatcagcgttgtattgcggcttacccgcagggaatccgccagctcgcgaatggaaggcagccgctcatctgcctgaatatttccttgctcaatcaatgttttaaattgctcgtaaatttgtttgtatttcggggtgccgcttctgaaagcgaaaatcaaatttttcatcagatgttctcctctgacatgtgtatttatttgaaactgtatctttttaaatgtcagttgatattttattatagcggaaagcgctttatcaatccatgttcagagaggagagttttgtatgtatattccggctccatttcagctgagtgaagctgaagcgtgcgatgtaatcaaagagtatggtttcgcagcattgttttcaacggcggggggcatgccgtatgcaacccacctgccattgatgatgagtaagaataacgaatgcttatacggtcattttgcattgccgaatccccaatggaaagagattgatggccaaaacgtattagccgtttttcaggggcctcattgttatatctcgcctaaatggtatgagacgaatcaggctgttcccacatggaattatgtggcggttcatgtttacggagaggcggagcttttggatgaggaagaaaccgtgcagtcgatgagtgatctcgtattgaaatacgaaagccccgacagcccgtacaaattagaggatgtcgatgcgaaattgctggcaggcatgaacaaaggggtaaaaggttttaaaatcaaaatcagcaaaatagagggacaggcaaagctgagtcaaaatcattcagccgcaagacaagggctggtcgtacaacagctcaaacagattcctcatacaaacgaacagctcatttccggcttgatggaagaaaacatcaaacgaatcaccgcaaaaaactgacaagcatgttaaaaacataccggcagcatgcggtatgtttttttctgattatgaagcttttctcaggatgaataacgactcgaacagcacataaatcaacggcgccattaaaatgaagaaagaatgaaaaatagcatacggtatgagtaagtaaacgataagtttcaatagaatggaagacgttttattcaatgtccagcggtttttcaagatatcagtcatacaggctgaaacaaggccgaccgtcaaatatccggctgctatgtaaagataaataaaaaggtaaaacgggtaagaagacaacgggggtgtgtcttcctgtgtcatttttaaacccacataaaagaccaataaaaagcaaacggacgaaacgagagctaacaaaaggtgtttatataaatacttcttcatgtgtttcacctgcctatggacaattatttctaaacatattatgacatggttttaccgctgctgaaagaatcggcagcgggcatgcgcccgtctatatgagcggggcgtaaagaatcaatatcatcttttcatgaatccggatgttttgttcggatggatgtaaagaagaatacaccccaaaaaaagctgtcagcttggtcctgacggcttatttttggtgaaaggcttatttctccgtggtgaaataaagcaatgctatgaccggaaaagcgattccaatccataatgtgatactccacccgcctgaggcgtatgcccatcctccgattgatgatcctatagcgccgcccagaaagaagattgccataaataatccgtttaatcggctgcggaattcaggtgccaacgaaaaaatggcacgctgactgagtacgagattggcagatacccccatatccaacaggatagctgcggccaccagaactgctattccgacgggagagctgctctgaatcatgagcgggagtaataaagaaacgatgacaacaccgagagcgattccggtggcaagccgggttaagccgcgatcagccagacggccgcctatcggtgcagccgctgcacccgcaatgcccgctaatgcgtacagcgcgattgccttttgagaaaaatgaaaagcaggaccggacaatagtaaaggtacagtcgtccagaataagctgaaagctccaaatacaaacgcatgataaatggcacggcggcgtaagaccggagtcgtgcgcagcagcttccacattgaaccgagtaagacggtgtagcttgtgtttgctgttggttttctggcaggaagcacttttgataagacgattgccaggacaacacttaacgcggcggataaagcaaatatggcattccacccccatatatcagcgaccagactggatatcggacgggaaagcataataccgagaagcaggccgctcatcacattgccgacaacccggccgcgtgcggcatctggtgcaaggtatgatgcgaacggaactagcacttgggccgcgatggatcccagtccgatgaaaaacgcagcggctaaaaacagtgttccatgcttcacacatgctgtcagagttagagcggctgcgcttagtaggagcgataccacgacaagttttctgttttcgataatatctcccaaagggacgagaaacagtaggccggcaacgtatccgatttgagtcagcgtgacaatcaatccggcactgcttggagaaagcccgattgccgcactaatgaatcctgccaagggctgtgcataataaagattagcgacaatgataccgcatgccgttgcgagaagaagggttaaaccagttgaaatcccctgatccgctgtttgtttattttctttagccatatgaatgaactcctttttaatgattttatgaggtttgataaatattttgctgattcatctcctttacgcagaggcttttggagtctgcatttcatcaagacttccctcaagttattttataaactaaacgttcagttttgtttataagtgaataatatactaaacgttcagttttgtaaatgggtttctgttttcttttttatacaggttaagtatactgaacgtatcgtttataattcgggaaggaatgattcatgtgcagagtaaacgaggacggccgcgtgatgaaggaacacataaggcgattctttctgctgcctatgacctattgttggaaaatggctttgacgcggtgacagtcgataaaattgcagagcgtgccaaagtgagtaaggcaacgatttataaatggtggtcaaacaaggctgccgttatcatggacagctttctttcgaccgctacggacagactgcctgtgcccgatacaggatcaacagtgcaagatatattgacccacgccgcgaatttagcaaggtttttgacgagccgggaaggaaccgttattaaggaattaatcggtgcgggacagctggatgcaaaattggcggaagaatatcgcacgcgatttttccagccccgccgcctccaagcgaaaggccttctggaaaagggaattcagaaaggtgaattaagagagaatcttgatattgacgtaagcatcgatctcatttacggaccgattttctatcgcctgttgatcacaggtgatgaggtgaatgattcctatgtgcatgatcttgtgatgagtgcgtttaagggagttcaagctacgtgaataaccgccgctcgaatcgggtgaaaagtatttgtgcctatggggcagaaaataatgaaaaggcagaacaaattgttctgccttcttcgctctatttgcgaaccgcccggcggccgccacgcacgtaatcaccgccgcaagccccaataacagcccgaagaaaggctggagaagctgcagagctgattcgcgggagtttcgttgcctgggcgctgtaaaggcagttctcagtttgacatactgaagctgagccagaggtgctgtctcagcaggaaaacatttataggacgggcaggcggagcgccgtatcaatattttgcaaattaaaccggacttgttcatctgtgttccacggatgataccagcctttttccatcatatagcgtgagatttgctcatgcatgtcgatggcttcttctaagtgacgggtgaggatcgctttcacttcaggcgttccggcttccgtcgccgccatcgcatagtttctgactccgctttttgccgaattcaataaatccatagcgacaatttggtctgtcagtgcatccatccccgtcaggtattcaataatcggattcattcgtcattcatctcctattcgtgctttgcatcagataaaatcgaggcaaattcctgcaattgccttgttgatgtatccgcatcctgctgcatgatttctttcagctgcggatcggatacgagcgctttcatggttttggatttcgtcaggcaaagtgacttaaaagaagccatctcctgaatttcgagtaattcatgtaaggcgctggccatttctgtagcctccgttctctaaggtttgagtacaactttaatacaatcatctgttttcgtgtcaaacatctcatagccgtgcttcgcttcactgagcggaatgacatggcttacaacatcacccggatcaattttgccggttgacaccagttcaaacatatacggcatataatggataaccggagcttgtcctgatcggatattgacgttccgctgcatgatatcgccaaggggaaatccgttgtatctgccgccgtacacacccgtaatctggatcgttccgccttttcgcaccgcttgggacgcgatgaccaatgcgctcatggcccgccttgaagttttaatccgctggcgaggaactcaagatctgtcatttttccgtccatgccgacggcgtcaatgacaacgtcggcgccgcctttggtgatttccttcaggtagctgcccgtattttcgtggtcttcgaagttcacgatttccactttattcgtccgtttcgcatgctggagacggtagttgacatagtctacggctatgacgcgtttcgcaccctttaaccagcagaatttttgagcgaaaaggcccacgggcccgcagccgagaacgatgaccgtatcgcctgcttttacgccggcattgtcaacgctccaaaaaccggttgtcatcgcatcggcaataacactcaatttctcatccggttcttcgcatgtttcggggactttaaaatgggtaaagttcgcaaaagggacgcgcaaatattcggcctggccgcccggatagccgccggtactccctgaatagccgaaataagcgcccatatcgccgttttcatttgattgatcacattggctttccaggtgatttttacaataagtgcattctccgcaggcgatattaaaaggaataatgacgcggtcgccttttttgactttcgtcacgccgggaccggtttcttccacaatgcccatcggttcatgcccgataatatagtcttcctgcaagttcggaatgagtccgtggattaaatgtaaatctgatccgcaaattgccgtacttgtgacttttataatcatgtcatcgtgtttttcaatcttcggatcaggcacgtctttgacgacgacgtttttcactccttgatacgttacggccttcatgctgtaatacctccagtgttagtgttcatcaggtgtgcggtcaaacatcccttttctgttcgtttcaacgggaaacagattcatgtttccgaccatgagggtatttttcgcagagagctggtccagtttatactgttcgctcagatcatgcgggtgaaaccactttttgctgaccatcaagtctgtaatttcctgatgcatcgcgattccttgcatgagctgtttgcgcagcaaagctcttacatctggcgaggcggtttctgttaaagcaacggcggtatttctgacgccttcttttgcgcgtatgagaaaatccattgcgaatgtcatatctgcgagttcagggacgtgtaatgaattgattggatctaaatggtcatggttcaatgatgcttaccttcctttcaattgatgatcgaagtcggccggttttgaggaacaggagcctgaaacgttgcccgttcataaaccgcctgcagatcagcaaggttttgcgaggcttgctgaacgtctttttccattaacgttttcagatcctgatcaaacacaagcccttgcatgagcttggatttcgctacacaaagcgtcttgaagttaatgatttcatgtaagtccagcgactcgtgagccgctaattcacgcttttccataatcgttttttaaacctcctcttctcaattacataattaatttcccctgagaaaagagctctagtcttacaaattttgtttataaaaaaagagagaagaaatttgacggtacattaaaaaagaggaagcacaatcgcttcctcttgttcacatggaatggctgtcggtgtcctgaacgtttttctgatgcgcgggcggttttgccgcgcgggagacagaccgctgaaacccgggaaaggtcataaaaaagatatgaacaaaagcagcccgcgaacaatcccgcaggctgttttttctttcacccgtcaagcaggacagaaggggaaggtgagaagcaggcgattatggtatgatgacaaatagaataaaacatcgtgaggccggtcggctaaaaggaagtggacagagattgtttggtacaaaacatcaagaagactatgtctcccgtgacagacgctcattgcatatgcttgcgcttcgggtgcccggtctggcgtttatttttatggtatatgccgcatcagtctctttgcagtacatttatgaaagctggacggttttattgctgctgttattcacgatattgatcgtcatttttgctgtgctgcactggcattcctatcgctgggtcaagaaaaaaacgtttctttatttcatcatacagggatttatcatatatacatcggctaacttgatgaccggcggctatatcgcggcggtcatcggtctctatgcctttttaatcgggcagattatcggaatggcggataagggcaaaacgccgctcatactctatcttttcattttaatgtccatagcagccctgcaccaggagcatccgcatcatctgcttcgtttcatcgttatcgccgctcccatcatgatcgtgattatcacatatgcggcaacatttttcgcgcaagttgatgaaaaaatcaaaacacagatgacgcttgaaaaattagagctcgctcaccggcaagtgaaacagctgacgcttcaaaacgaaaggcagcggatggcgagagacttgcacgatacacttgcacaagggctggtcagcttgcatatgcagcttgaagcggtgcatgttcatctttcaaagggtaacactgacagagcgaaagacatcatcagccagtcaatggacagagtgaagggcacattggctgatgcgcgctcggccattgacaaccttcgcagcaaatcagaagagatcgggttcttaaaagaaagcatcactgaacaaatcaaccattttacagaagcctccgggctgtcttgttttttagattacagcgtgcatcatgtgcttgacgttcatacggcggagaattgccattacatgatcggagaaggcctgactaacgccgccaagcatgcagaagcaaagaatgtctgggtgtccgttcaggaagaagagggacagatccgcataaccgtcaaagatgacgggaaaggctttgatgccggaacagaaatgagaaaaagcggacattacgggctgctggggatacaagaacgcgtcaatatgatgaacggcactttccgtataacaagcgccagatcagcgggaactcaaattgagatcatcataccaattcaaggagaagcggaacatgtataaagtgttaatagcagatgaccatcttgtcgtcagagaaggtctgaagcttttgatagaaacaaatgaccattacaccataacgggagaggcggaaaacgggaaaaccgccgtccgcctcgcagcggaactaaagcccgatgtcattctcatggatctgtacatgccggaaatgagcgggctggaagccattaaacagataaaagagcattctgatgtgccgattattattttgacgacctataatgaagatcatctgatgatagaaggcatcgaatcaggcgcgaacggttatctgctgaaggacacaagctcagaaaccttatttcatacgatggatgcggcggtcaggggagaagtgcttctgcagccggacatcttgcggcgtttccgggaaaagaaaatggaacgggcaaatgccaatgaaacacagctgacggacaaggaaatcatagttctgcaagccgttgcgaaaggacataaaagcaaagcgatcgccttcgatttaggaatctcagagcggacggtaaaagcgagattaacatcgatttataacaaattaggcgctgattcgcggacggaagccgtcaccattgctatgcaaaaaggcattctgaaactgaatatataatgaaaaactgcccaaacgtacatgcccctatgtacgttttttttatgtgaatgtgaactacaattaggcagaaagtaatgattggagaggagtattcgatgtctggttttttatataaattagggggatggtctgcccgcaaccgattcaaaatgatcagtgcgtggctcgtgatactgatcgcttcgattgtgatcgccatctcgttaaaacctgctttttctgaggatatgtcaattcccgacacaccttctgaaaaggcgatggatgtgattcaaaaagaattttcaaaggggcccgataaaggaagcatacgggttattttcggagctgaagacaggaagaaattgacgtcaaaaccggaaaaacaagcgattgaagagacattaaagaagatcaaaacagatcattcggtcgcttcgattgcaaatccttttgaaacaggaaccatttctaaagacgggtcagtggcatatgccgatattacgtacaaaaaagcggcggatgacattacggatgcgtctgtttcacatattaaacacagtctgtccgccgccggagacaagggcctgcagacggagctcagcggcgatgtgccgggggccggtgttgaagccggcggtgtatctgaaattgtcggcgttgtgctggctttcgtcgttctggccattacgtttggttcattagtcatagcggggctgccgattgtcacggccctgatcgggttaggtgtaagcgtcgcgctgacgttaattgggacacagatctttacgatagcctcggtcagtctctcattatcaggaatgatcggcctggccgtcgggattgattatgcgctgtttatctttacgaagcatcgtcagtttttgggcgaaggtgtacaaaaaaatgaatcgatcgctaaagctgcgggaacggctggcagcgccgtcgtttttgcgggactgaccgtgatcgtcgcgctttgcggattgaccgttgtcggcattccgttcatgtctgcgatgggattgactgcggcactcagtgtgctgatggctgtattggcatcagtaacgctggttcctgcggtgttgtcaatcgcaggaaaacggatgattccgaaatcaaacaagaagaaagaaaaggaaagcgccgacacgaatgcctggggacgcttcgttacaaagaagcctattctgttaagcattttcagcattattcttttagctgtcatcagtctgccggccatgcatttagaactggggctgcctgatgcgggaatgaaagcgaaagacagcccggaccgccgcgcctatgatctgttgtctaaaggattcggcgaaggctttaacggcaagctgacaattgttgccgatgcaaaaggagtcaaggggaataaaagtgaagcatttcaagacgccgtgaaagaaataaaggacttgcacaatgtggcgagcgtcacacctgccatgccgaatcaaaaaggggattatgccatcattacggcagtgcctgaaaccgggccgaatgataaggcaacgaaagagttagtgcaggatatacggaaacgatcagacaaaaacggcatccgcctgctcgtcaccgggtcaacagcggtgaatattgatatttcagaccggttaaacgatgcgattccgaaattcgccattcttattgtcgggtttgcgtttgtattgctgaccgttgttttccgctcgcttctcgtgccgcttgccgccgtcgtcggctttttgctgacgatgaccgctacactcgggttatcggtattcgttctgcaggatgggaatttcaccggcttgctcagcattccggaaaaaggtccgattctcgccttcctgcctattttagccatcggtattcttttcgggctggcgatggactatcaagtattccttgtcagcagaatgagagaagaatatgtcaaaacaaaaaatccggtacaagccatccatgccggattgaaacatagcggacctgtcgtaacagcggcgggactgatcatgattttcgtctttgcgggattcatcttcgcgggggactctacgatcaaatccatggggttggcaatgaccttcggtgttcttttcgatgcgttcattgtaagaatgaccatcattccgagtgtcatgaagctgatgggacatgcggcctggtacttgccgaagtggctggataaaatcattccgaacgtggatatcgaaggccataagctgacacaaggcaaaacaccggagaaaccggaagaataaaatgaaaaagcagatcgttatgatctgctttttttatgtgctgaccgcattcatgaacagagaaaaaagctttttcatgtcttcatgtttttttgtcagcatttcgggatgccattgcacgccgacgacaaataattcacccgttcgttcaatcgcttcaatggccccgtctttcgcataagccgcggctttaaatgaaggcgccgtctcttttatgatctggtgatggaatgaattcacccgcgctgaatcgccaaacaaggtatggagacgtgtccctttttcaaaagaaacatgatgggtttttaacggcggatctttttcttggtcatgcttaatgtcagcaaacgaagcgtgtgccaggtcttgatataaagttcccccgtaagtaacgtttaacatatgcatcccccggcagatggccagtatcggcttttctaaagcaaccgccgtgagaatcagctccttttcgtaggcgtcccgatcaggaaaggtctttcttaaagcctgtaaaggttcttcgccgtaaaacagcgggtctatatcctggccgccggacagaatgatgccgtcaacatgagagacctgttcctttaaaagcgccgtctcttgaatcaccggcaatataaacggcacaccgccggcctcagaaacagactgaatataatcattattgacatatgcccgattataacccgggaaagggccggattgatcagccataatgtttcccgtaattccgatgcgtttggccattctgcgttcacctgaacctttctttctgaaccttctcgtatgaatctgaacgtaggttgtacaaatcagtttgaaattattcttcataatacgtgaactttccaaaacaaaacccgtgacaatcacgggtttttacattcatttcaacttcttgatttcttccgtcagctctttgaacttttgatcaagctcacgatattgtttatcagccggagtcatgaagctgagttttccgaggacttcctgccgttcggtttcaaactttaatcgcagttcttcagcatcatccctgacggagggagattctttccattgttttcggacgctgccgtttgagatatcaagccggatgtccgtcgtcttttcgacaaagtaacgatcatgcgatacgatgatgagcgttccgtcgtatcgggccaaagtgtcttcaagctgctcgcgtgacggcagatcaaggtggtttgtcggctcatccagaatcagcacatctttctcccccagaataaacgccatcagcttgcatttgacccgctctcccatgctcatcttgccgatgggttccgtccattgcgctgcggtaaatcctaaatgcttcatgagggattgaacatttccccttgcttcgaacgtttctttgtaaaaaagctgttcggggttttatcaagcggaaggtcgaatacttcctgggttaaatagccgacgtttgcagacggagaaatccatatgccgccctgcgctttttcctgaccgaggatgaccttcaataatgttgttttcccgctgccgttcgggcctgtaatcgcgatcttttcaccgtgcatcacagtgaaattcacgtttttaaaaagcgttcggccttcatatgactttgtgacatcacttacttctaaaaaacgctttcccgcttttttgcggtgctcaatggaaaaacggacttcatactccgcttcaaccggttctgctttcgctttttcaagctctttttcaagacgcttctgctttgatttaatctgggcgtccgtgcgttttgcttttacgcggtgatattctttaaagccttctattttcgttgattgggcgtgggctttttttgaccaggcgctcagctcgttcatttgagcttcaatccgtctgatcatatgctgctgattctcatattcccgctgctgtgtcagccttctctgtttgcggacctccatatagcttgaataattccctttatgttcaatgagtttctttccttcgatggcccagatttttgtcgccgccgcatctataaaagcacgatcatgtgaaacgaaaataatggtgcctttgtaattcttgatctgattaagcagtatttctaaactgtgctgatcgaggtggttcgtcggctcatctaataacaaaaggccgcttgaggaggagaaacctttggcaagacgggctttcaatttttctccgccgcttaattgcgaaaaggcgcgtgcgggcacgttccacttttctaacaaggctgcctccgcaggctccggatggccggaatcataagcttccgtttcttgttccaccatatatatgttcacatcttgcatcatctggatctgtccttgtgacggcgcttttttattgcagatcaattgcagcaataaagatttgccggcgccgtttttaccgataacaccgatgatgtcgccttgctgaacactcgcgctgatctgttcaaaaaggggaacgctgttgatttcgtaactgatgccgcttatttttaacatttctttcatatgtcaatccctcgctttaaagggaggacaaaaaaatcctcccaattgatttggaaggattagccgtacctgtgcgtgatcaaataagctatttttacatagctttctcgtatcgtatagaaaatgggcagactaatcctattttttctgatttgaaatatttgatttcaaacggtcaaaataagattagttaatcattgtccacccatcatcccttcgtatttgttacgaacagtgtagcacacacttatctgtaaaagcaaagggtataagcctttttattccagatcggaggcttcccactcttcttctaaaacggcataataatattcatcccaccattcattatcatgggggatgcattttttaaacaagccttcccgcctcatcccgatcttttccatcacccggtgcgaagccatgttttccggctgacatgtcgcaatgatccggtgtaatttcatcttgttaaacccgaatgccagcacggcgcgcgccgcctctgaagcatatcctttgccctggtattccgggtgaaacacccagccgatttcatacgtatgatcgccaaaatactgaaaaaaaacaatgtggccaatgaccgttttctcatccttcaataaaacgggaaacttcccggcatgttcaccgctgttttcagtaacgaatttcctggcatcttcttcggtaaagacaccctctggtatatatttcatgacactcggattcgaggtgtacgcatagacatcctgccaatcttccggttcaaatgtccgaatgacgagcctttcagttttgatattcatttttttatgttcctccatcaaaaaaggtttcatttactacttcgattgaaagatgtaaaaaacctttgagcggggaagagccgaataaaaaaagcctgcagctatacactgcaggcggttatttttcatttgcggcggcgggcaggtttgtaaacccgaattgccctccgacagcttcttttacttcatgaataacgataaatgatttcggatcaattttttgaacatgttttttgattttcagcaattcgttctttttaatgacaacatagataatgcgcttgtctttgctgccgtaatacccgtatccgtaaaaaatcgtcgccgcgttgccgtactcggaggtgatggctttggcgatttcttcgtattggtcagacataatggtgagggcttttttattatggaaaccctcaatgacaatatcgacgattttggcgcacagataaacgaatataaacgtatacagcatatgattgattccgatcgctaaaacggatgcgaaaatgatgacacaatccatataaaacatgcttttggagatgttaaagccctttgtgtaattcaataaatacgccaaaagcgtggtcccgccggtagatccgtcagcgataaagatcaatgccagccccgctcccatcagcagagcgccgaatacaatcccgagcaccatgtcgtgcacgccgaacggaataaagctgacgatgctgagaaaaacagaagtcattcccgtaccgagtatcgtgtataaaatcgtttttttcgttaaaaatttataagccagcccgataaaaatcaaatttacaaccagagtcgtaatacttgcaggtatatggaaaagataatataaaacgagagcgattcccacggtgctgccgtcccctaaatgattcgggatgacgaaaaattccacggacgccgcgataagaaaggctccggccataatcatcagtatatccttgcaaatgttcttcatgtgcaaacctcctccgcagtcaaaaatatatataaaacaaaaacgcctcaaaaattatccagcagaactaaataatttttaagacgaatcattcacaatctcgtttgttcattcagtaaagaatgatcagcttcaatatcgaagattatatagacaccttcacatcttgtcaatgccgtgaaaattgattttctgcagtgtatatgaggtttaaaccaagttaaaacgaggaattatatcagaagagttttcatttccgctctatcaataagagaaatgtaatgagagacaacgaagaagggatgatgacattggaacgaatttttatcagtccggccaaatacgtgcagggaaaaaacgccattgaaacgatcggcggacatctggagggcgttggtgaaaaagccgtcgtcatcgcggacaaaaccgtatgggatatcgcgggccacaaggtgacggctgaattaaagaaaagcaatatctcttctgaagaggcggttttcaacggcgaagcctcccaggaagaaatgaaaagaattgccggcatcgcagaaaaagcaggggcgactattgtcatcggagtcggcggcggtaaaacgcttgatacggccaaagccgtatcagatgaaataaacggctacaccgttatcgtgccgacggccgcttcaacggatgctccgacaagcgggctgtctgtcgtgtattctgaacaaggcgcgttcgaaaactatcgtttttatcataagaatcctgacttggttctggtcgatacgaaaatcgtcgcggaagctccgccgcgctttttagcatcagggattgccgatgcgatggcgacgtggatagaggcgcgcagtgtcatcgccaatggcggtaaaacgatggcaggcggaattccgacaatcgccggagaggctatcgcggaaaaatgtgaagcggtattattcaaatacggccgtctcgcttatgagtctgtgaaagcgaaagccgttacgcccgcattggaagcggtggttgaagccaatacacttctgagcggactgggatttgaaagcggcggcttagctgcggcacatgccattcataacggatttaccgcgcttgaaggtgaaatccatcacttgacccatggtgaaaaagtggcattcggcacgctcgttcaattggcgctggaaaaacgttcgcttgaggaaattgagcggtatatcgcgttttatatcagcttggggctgcctgtcacacttgaagacatcaaaatgaaagacgcatctaaagaggacattatgaaagtggcagaagccgcgacgattgaagaagaaacgattcatgccgcttttgacgtgacggctgacgacgtggcggacgccattatagcggctgatcaatacgcaaaagcatttaaagaaaaacacgcgtaaaaccttttaccgcgtgacccggaaccaagggctgttacagcccttggttttttttatgccctttgaaaacttttaaaaataaagaaaaaattatgatacaatatacaaatgttttgagagattgacaaaggaaaggtgggaacgatatgctgcataatccgaccggtaaggagcggcttgcgctggcttttcttctcggaatgcttgcgatactggggccgctcaatatagatatgtatctgccgagtttccctgaaatcgccgaagatttaagcgcccgcgcttcgcttgtccagctcagtttaaccgcttgtctgatcggactgacaatcggacaggttgttgtcggcccgttaagtgacgcgaagggaagaagaaaaccgttattgctatgtatttttttatttgctttgttttctctgttttgcgcgcttgcaccgaacatttcaacactggtgattgcccgttttcttcaaggattcaccgcttcggcgggactcgttttatcccgtgcaatcgtcagagatgtgtttacgggaagagaactttctaaatttttctcgctgctgatggtcattaccgccgtcgcgccgatggtggcgccgatgacgggaggcgcgattttattgcttccgtttgcatcatggcatacgatttttctgtttttaacctttatcgggtttttgcttgttctcatcattgcgctcaagctgacagaaaccctgccgccggaaaagcggattccgagctccatcggaaattccgtgcggacaatgggaagcctgctgaaggatcggtcatttatcggctatgcgctgacggtcggttttattcacggcgggagctttgcgtatgtctccggaacgcctttcgtgtatcaggatatttacggagtatcgcctcaggtattcagtgttttattcggcataaacggtctggcgatcattaccggaagctttatcatcggccgtttcggcgggatcattcacgaaaaaagcctgctgaaaatcggcgtgattacagcgatgacggcgactgccgttctgctcgtcatgacgatcattcacggaccgctggcggcactggtgatttccatttttatttatatgattacgatcggcatgacgctgacaagcacctttacattggcgatggaaaagcagggacaccgcgcgggaagcgcaagcgcactgctcggcatgcttccgcttcttctcggttccatcgtgtcgccgcttgtggggatgaatgaagcgacggccgtgccgatgggggcaattatgttcacgacatccgttatcggttccatcgctttttttgccttaacaacaaaaccggagaaagcaaaaaaggagtgaaatgattcactcctttttttgatgcccgctattcatatttcttcagcacgatcgccgaattatgtccgccaaagccgaatgagttggaaaggccgatcgttaacgattgatggcggggcccgtctgacacatagtccaaatcacatgccgaatcagggtgctgcagattgatcgtcggcgggatgatgccgtgtctcaggctttctgtcagagcgatggcttcaacgccgcctgccgcgccaagcatgtggccgagcattgatttgttggccgtaaccggaatgtcatacgcaagctccccgaataatgttttgattgccaatgtttcagaaagatctccggcttttgtgcttgtcgcgtgggcgcttacgacatcaatgtcttccgctgaaacgttcgcctttttcaaagcatttttcatcgccaggtatgcgcccgtcccttccggatgggaggccaccatatgatacgcgtcagagcttgcgccgtagccgagcacctcacagaggatcggggcgtttctgccgattgcgctatccaatgattccaatactaagatgcccgcgccttcactcatgacaaacccatcgcgatcagcgtcaaacggccggcttgccgcggcggggtcttcgtttctcgctgacagcgcgtgggcattgccgaagctggctaatgacaaattcgtaatcgccgcttccgctcccccggcaaacataatatctgcgtcatcattccgaatggcgttgaatgcttccccgatcgacgtattgccgatggaacacgcggtgacgggagaaagtgaggggccgagcgcgcctaatctgatgctgatttgagcggcggccgcgtttgagatcatcatggggacaaggctcgggctcacttttcgcgctccccgttcatttaaagtatgaacgttatcaatcaaagtcgtgatgccgccgattcccgagccgacgtacacgccgaggcgttcacggtcaatctgatcgagctgaatcccggagctttcaagcgcctgttccgctgccgctaaagcaaactggctgaaacggtcaagccgtctcgcttcttttctgccccatctttcttctgcgtcaaaatcacggacggtgccggctatttttgtcttggagccggagacatcaaacgaatcgatgagagaaattcccgatgttccttccgtcaggtgtttccaaaatgtatgcacatcattgccgagaggtgaaatcactcccattccggtgatcacaactcttttcatggtcattcctccttcggtatgtatttattgtaactcgcaattatcctattacaagttgttgattatcctagtataatgaataccagggtaagagaggagagattcggtatgataccagaaggaagattgcaggcgctctcagagtttttaaaaacgcagcgggccaaaatttctccgcagatggccgggctgccgatgggcacacggagaagaacgcccgggctccgaagagaagaggtcgcgcaattagcaggcgtaagcaccacgtggtatacgtggctggagcagggcagagacattaaagtgtccgcagccgtattggacgcggtttccgatgcgctgcagctcaacaaagatgagagaaattatttatacgcgcttgccattgaggagggcgtgaagcagccgtttgccgcggaggaagaagcggttatcagcccgtcgctttcaaaaatcctgcaggagctccgttattgtcccaccattatctcggacaggcgctgtcatatcgtgggatggaatcaggccgcggctcacgtgtttttagattttgaacaaattcctcctgaaaaacggaatctcatagagctattgttttccagaaaagaattaagaagtttagctgtgaactgggagcactttgtgaaaggattcatcgccattttcagaacgtactacggccagtatgtagctgatacgtggtattctcagtttatagaagaaatggagaaaacgtattcggaatttcatacgctgtggaatgagagcgaagtcagctcggcacccgaagtattaattgagttccgccacgcgaaggcgggaaaaatggtctttaacctgacttcatttcaggttcagggcaacagtgatctgcgctgcagtgtgtatacgccggtagatcataccgaaacggaagcaaagctgaaaaagctcttcgaaaacaggtgaagaacagaaaaaacgggaggcggccgcctcccgtttcagtttaaaataaaagcatgagaccggcgatggccggtgttaaaaagatggctgatttcagaatgactttcggcacgtggttggtgaatttcgctccgacatatgcgccgcacatcgtgccgatcagcactttgaccaacagtatataatcgacaaatccttccgtcacataaccgagtcctccgccgaccgcaagcgggataatgacaagcatggtggtgccgaccgactggcggatggataagcgcaaaagaatcattaagccgatctggatgaaaggggcagagccgatcccgaacgttccggacaagattcctgcgatgataccgagtacaacggctttcacccatatgttcagattgctttgccgtccggaatcttcatgtgtttcttttacaataaataaccggactaaaataagcagagcggataaaaacagcatgcccgccgtcaagtaatgcagcaaatctgcagggataagggaagtaagccttgccccgaaaaacgaaccgaatgccgcaaaaacgccgacgatgaggccgattttcatctgaatattgccttcacggtagtggctgaaagcccccgataaacttgtgaaagccattccggcgagggaggtgcccaaagccgtatgaatcggtacgtgaaacagtatagttaaaagtgcaatgacaaaaccggctccccccgcgccgataaaccctagaataatcccgagaaggaacataacgagtataataagcacaatcttctcctccatttagatgcctgatcaccatgttcagatccgctttatcaggtttttaacaatcgatcgtcgtccgtcgaccgtcgtccattatctttatgttacctcaaatttgagggattggcaagaagccgaatcgcttttatacagagggtttacagctctttcaccatcactttttccccgtttgagtccagctctccattgaataagaagccgaatttttgataaagccgcaatgcgtgcacgttatcttcaaacagacttaaataaatccgtctgcactcatatattcgaacgagatggcggataagggcatcaagcaacagcctgcccaatccacgtccctgataacgttcatcaataaaaaaacggtcaagccacactctgccgttttcattttcctcatcatattccggaaaccatccgtacatggcaaagccgactaattccccgttaacataaagaccggccggctgataatgccggcaatcctcagcatcttgtaagcactcttccgcggtttcaataaatgaagtctggctttcccttacatgaagcgccagtatatcagcacggttttcttccgtgactgctctgatttcaatcgtcatacttgatactcctcttctgctttttctgagacggtaaagctttcattgcgtaagccatttgtgaatcagccttctctcggatacaatgatcatcataaaggatatggttaccgtatagtcaaggaggcattatgagcgaagacgtcagaaaatacttcacaacgggtgaatttgcaaaactgtgccacgtaaaaaaacaaaccctgttccattatgacgaaatcggcctgctttctccggaaatcaaaaaagcgaacggatacagatactattcctatcatcaattcgaactgttccaggttatcggtctgtttaaggaggtcggcgtgcccttgaagcagatcaaaccgctcttaacagacaaaacccctgagggtatcatcacgcttttaaaagagaaatcatcagaaatcgaaagcaaaatcaaaaagctggagcacctgcaaagaatgattcagacaaaggtgaagctgaccgaacaagctttggagacagacttctcctccgtctcattgcagcgattagatgaagagacacttatgataggacgacccgtactccatttgccagaacggcaatacactgcggccatttccgaattgatccgctatatgcgggtacatgaactcgatcaggggcatccggtcggcggactgtttgcgcgggagcagattctgaaaaaagaattctacaactacacccatttttatatgaagacagaagaaggcatagagaataatgacctccatatcaagccgaaagggctttatgccgtcgggtaccaaataggggatgaagcggaagcggcttaccgcagcatcatgcagtttattgaagagtatgggctggaaatgggcgattatgcatatgaagaatatttgcttgatgaggttgtggcggacgggtttgacaatcagatcacaagaatccagctgcaagtccgcaatcgataaagccgatgccgccgttcgtttacgtcttctgacaaaccttgtataatgagaaaaatcagattgcaattgaggtgaaaaacgatatgtttctagcgcccttatttgaacatgatgtaccggcagcacttctccgcccttaatggaggaaagtgactgcgcttctctccgttaaggcatatgacgtgacctaatatgataacggagggtgcatcaaattgaaaaatacattgttcggttcgatttatttggcattggccgccagtatctggggcggtatgtatgtcgtcgttaaagtagtggtagcggtcattccgccgcttgaactggtatggctgagatatgcggtggcgcttttttcgcttttgattctcagtttatttacacgccaatcctggaaagttcataaacgtgatttattactgatcgctgcgatcggattgatcggcaacacgatttcgatcgtcacgcaggaaatcggcacgaaattatcaaccgcgcagatgggtgcgattattacggcatccactcccgcatttatggttgtatttgcccggctgattttgaaagaacggttaacgctgaaaaaaggaatatcgacagggctggcgacgatcggagtattgctcattgtggggaacggagatctcaatatgtcgagccagttcggcggtctctcgcttctggctggggcgctgacatgggctttgatgtccgtgctgatgaaacgggttcccggccattactcaccgcttgtcgtcacaacgtattccatttgcgtcgcatttgtcatcctgaccccgtttacagagggcccgcttcgggagattcctttgtctcagcttgcccggcctgagatatggggcggacttttatatctgggtgtgatctcaaccgcctgcgcgttcatgctttggaatcgcggattacaattgctgaatgcggcaagcggcggtctgtttttcttctttcagccgctttccgggacattgctcggctggctgctgctgggagagacgatcggaggaaccttctggatcggggcggcccttattgtttcaggcgtcgttctcgtcatgaaagaaaaatagaaaatgaaaaaaagccattcagcaaatgaatggctttttctgatttcccggcaggattcgctccgccataaacagaaaacaaggagcagaaacggggtactctcaaggtgcaattcgggtttcgtttaattaacataacgggcggtggaaaaaatggagccaaaatggcttgaatgggcaaaacagcttcaatccgcggcgcaagcggggctggcttattccaaagacatatatgatattgagagatttgaagaaataagaaaaataagcgtggatatcatggcgcaacataccggcatcgacaaaagcatcatcaaagacgtattcgccggtgacacgggctatcccactccgaaagttgatatcagagcggcagtttttaaagatcagagcatattaatggtaagagagaaaagcgacggcagatgggcgctgccgggcggatgggctgatatcgggatttcaccgggcgagaccgctgtcaaagaagtaaaagaggagtcgggaatcgacgtaaagcccgttaaactgttagctgtaatggataagaaatgccattcccacccgccgtccgccgcccacgtttacaaagtgtttatccgatgcgagatcatcggcggccggctcagggagggaacggaaacaagcgcggccggcttttttgcggaaacggaactgccgccgctatctgaagcccgcaatacggaaagtcagattgaaaagatgtttgcatatctcaaacatccggacgaacccgtttattttgattaaggcagcaagcagaaagaaaagggggcccaagtataatggaggattcaattaaacagcaggcgcagcggcaatttgctaaaaacgccgcgaaatatgtgactagtcccggatacgccgcaggagaggatttggcatatctcatttcagcttccggtgccgaaaagcatatggacgtgctggatatcgcgacgggaggcggacatacggctaacgctctcgctcctctcgtacgctctgttatcgcatatgacctcacggaagaaatgttagcagccgctgaagcatttataaccggaaacggatggacgaacgtgtcattcgaaaaaggcgatgctgaaaagatgccgttttccgatgctgctttcgatatcgtcacatgcagaatcgcggcgcatcattttcccgatgtcagagcctttgttcatgaagcgtttcgggttgtcaaaccgggcggcagactgcttctcattgacaataccgcacctgaaaaggatgaatatgaccatttttataatgacattgaaaagaaacgggatcagagccactttcgggcgtggaaaaaaacagaatggcttcgttttctggagacagccggcttccggattgaatccgctgtctgctttttgaaaccatttcaatttaccgtctggtgtgaacgggcaagcctgactgaagagaaagccgcattactggaaaaacagatgctggatgctccttgtgatatacagcggtttttttctgtagaaaaggatcaatcaggccgtattgcgggcttcacaggtgaatcggcctgtttctgcgcgctccgtcccgtctgagacgaaaaaaccgctgtgcagttttcctgcccgcggttttttcgtattatctgttcttgatttgagaaataatagcggaagtgacatcttccgttgaatgttttccgccggcatcaggagtcagaataccgctgtttgtgaccgtttcaatagattgtaagaggagatggcccagttcctcttctccgaatgaatcgagcattaatttcgccgtccatatttggccgataggattggctattccttttccgacaatatccggggcggagccgtgaacaggctcaaacatggaaggatatttgccgtttacattgatgttggctgcgggagcgattccgacgcttcccataatcgccgcgccgatatctgtcagcacatctccgaacagattcgaagcgacaatgacatcaaagcgttcgggctgcgtgacaaagaaggccgccagtgcatcgatgtgctgggaatccgtctcgatcccggcgtactcccggctgacctctttaaagatgtcatcccagaacggcatcgagtgaacaataccgtttgatttcgtcgcgcttgtgacgtgtttccgccgattgaaacaagtttgtttgaatgctgactgagtgagtcaactccttaatcctccctgcaatccgcatactgttgactcactctgggaacgcatcatcacacaggctccctgacatgcagatcgatttccacttcagttttcctttttcattttgcacatttctcctgtaataaaaaaaagcaggccatcgcctgctcattatgtattacttagtcttatctatatttatattttactccagataccttagtagatgcatttgaccacttataaacggtaaccgtgtaagaaatctctaaaccctttttcttagaattagcagttttaaaaggcttaatcatattattagctcctacttgatacattaaaacacttaaaccagtagaagggtgtaccaacccaataatataaccgagaataagccctttattagaccccatgctgttatatctagaaaccacttttttcacctgattttttgtgtaataaacctttaccctttttttaagaagaacatcattatcacactgagtcccaagatttgtccgtcgacaagctgcttcagaacttggagcgaaagcagacaacacagtagcgagaatacaccccgctataaataatttagtaaccttctttaacacttttttctctcatcacctttactccgtttcgcaatgctataaatcactaatgcaccaacgaatatagcaaacaaaacagttaataatacattacttaagtcaaatacagaattaagtaataatactataattatatataatatcaaaaaaagtaaaatatttttttcatattttttacctctctaacttttttgtgtaaagacatatttgcggatgtaagatgccaatagaccatcttaatcgacctgtcttgtaggtgtatcctcttttttcaccacaattaaaggaggggttaccgtttccttgcagttcccctgctgcgatttgacatacaattttctctctctatctctgtaaaaaattgtatcatttctttgtcaaaaccccagccgaacgctgccggttcgaaaacagatcactcattccgtaccccgccgggaaaggaccgcgtattgaatggcgatttcatcttcaccctgatagatgctgctgccgacagagctgtactcaccttcccggacgtttacagatcaaaatcggagatgtagttaccggcgtatcttgatgggcagcccccacagcgaaacatgatcggggacgagtttttgattccccaccgctcccaaaaacaaagcatcaaagtgctgtaacgtttctaatccatcatccggcatcatagtcccgtgctccaaataatactcgcagctccgcggaaaagaagtgaaatcaaaggcaatgcctccatgtaattcggcgatcgcgttcaacacccgctccgcttgcggaacgacttctttccccacaccgtcccccggtatgccggcaatctagtatgtcttcatgtttccgtcacctccgaatgaattgttttcggtttacggaataccctcgaccaactatacttccatattacggcacctccgttatgctgacaagctctggaatgttgcttccatagataaactgttatatgatcttggtaacaataaggcctaaattgtatgaagaggtaggaaagatggataattttaaattagataagccaatcccgtattatctgcagttttattcccaattgaaaaaaatgatatttgacgggatttttaaaccgggtgaacggctgaatgagactcagctggcgaaggatttcggagtcagccggtcgccggtcagagaagccatgcggctccttgaaaaggacgggcttctgacggcagacgatcgaaacggctttgtcatttattctttgtccgttaaggatgttgaagagatttatcaaatcagaatgtcacttgaatcattggcggtcgaactggttattgatgaagcggctgagagtgaaattgacctcattgaaaaacagctgcgggagacggaagaagccatcaataaaggcgtcaaagagactgagattatttccttaaacgagtcgtttcatcggctccttgtggatttcagccgcaacagccggctggccatgctgcttgagcatgtcaatgtgctgattcatttttgcagagttcttaattttaaaggagatgaccgtgcggaggttatcctgcatgagcaccggaaagtctttgaagaaataaaaaagggcgataaaacaaaagccgtgcaatatatgacggagcatctcaagcatgatgaagaacatctgaaaggtgtgctcaaagcgggtgaaacagacgaatcatcacgatagacaaggtgaaaagccttgtctttttttgccgatgtcatcgaaccgtcataaagacctgacgaatgttccttgcatgattttttccgcgtcatttatgatggatatggaagagacgcaaaaaaggcaaaggagtttgaaaaatggcgaaacatattctgatgatcaattttcccgcagaaggacacgtaaacccgactttgggtatgacaaaggccttcagcgaacggggcgatcacgttcattatatctcaacggaaaaatacaaaagcagactggaaggagtaggagcgaaagttcatcttcacagcgatctgctcagaatgacacccattgatcccggcagtccgtccggcatacttgcatttttaaaggttcatatcaaaacgtcactggagattttacatattgtgcagcggctggcagaggacattcaattcgacgccgtctattatgataaatttggtgcgggagagttggtgcgggattatctcaacattcccggcatctcttcttcagcatccttcctgttcaatgaagaccgtctgaaaatactgccgctccatccggaatcgggcgtgccgtttcagccggacagggaatgtgaagagctgttggccgagatgaaagacaaatacggtgtcgcccctgacagcatggttcaatttatgaacaacacaggtgaattgaacgtcgtctatacaagcagatattttcagcccgaaagtgagacattcggagatgagtatttatttatcggtccgagttttccgaagagaaaagggcgcgtcgacttcccgattgactcattaaagaatgaaaaagtcatttatatctcaatgggaacggtgctcggggacacggaagcgtttttcaatctgtgcatagacgcgttctcagattttgaaggaaaagtagtcattgccgccggggaaaaagccgatctgtcgaaaatcaaacaggcgccggaaaactttatcatcgccccgtacgtgccgcagcttgaagtgctggagcaggccgacgtgtttgtcacgcatggcggaatgaacagtgtaaatgaaggcattcattatcaagtgccgctggtcgttattccgcatgataaagaccagccgatggttgcgcgccgcctgactgaattggatgcaggctgtacagtgcaaaaagatgaagtgagcgctgaaaaggtaaagcttgccgcggaagaagtgctgcataacggaaaatacaaacaaggcattcaagccattaatgaaagctttaaagaatgtatggacatgcaggatgttctggcccggatcgaccggtttattgaacaaaaacatgctcaataatacatggaaaaagcctgtttcctctgccaaagggaaacaggctttttataatggcttttagatgatgtgatgttcttcatttgcaagtttcacaagagtcagaagagattctgcctcacgtgcgttgagtgtttttgccagacggtctttttcaaagatctgctggccgaagacattcactgacgcctggtcaaccgccgtgtgccagttcttttgtgaatgattctcggaaaaagagaaaacaaacacggcaaagaccgctataagcatcgccatgacccaaaatttttgccgatttcctgctgctgacataggccgcctcctaacgttcattttactggtattagatcatatatgagctgtttttcatagagtaaagaagtcattatttcaggtagtccaaatgaaacggagcacagccgaaagcccgccggtcaggccgatgagccaattcatattttgttcatattttattaaaagtttatccaagcctgtcctttacagtggatataaccataaaacgctgctgaaaggggccttgaaaaatgcatattcatatgatcaacaaaaaccagtttgagagtgacttggaggcggccggcttcatccgtcaggcagatgatattatcggcaaaatgaaagaatacgtaacggaatacgcctcttcatccgaacggtttctgattgaaattcaaaccgtcatgaacgaatacaaagccgtcatctgtgcgatgttttcgactatggaaattgccggcgcaaaaaaagacgagaagcatgttgagttcgaagcctgcacagtgttgtgcgaataaaagaccttcattaaacctccgcggctgcctgaacggcagtttactgactggtgttccgggaagggaaaatattgaaacttctaaagcggctgttcgtataaaagagtaaatcagcttgtatatggaggttcgtgaaatgaacgataagaaaaaacaagcttttgaacagcttttcagcactttagacgaaagacatgaaataaacggagctgtattggcagcggaaaacggccgcatcttatatcagggttcattcggcgctgcagaactgaaaacaaagaggatgctgaatgaccaatcagtctttgaattggcctcagtatcgaagccgtttacagctttaggcgttatcattttagagcagcgagggaagctgcgttatgacgatatgatagagcggtggcttcctgattttccttatccgggcattaccattcggcatttactccatcatacgtcaggattgccggactatatggagttatttttaacacattgggaccgggacagaattgccgttaatcaagatgtgatcgatatgcttaagcagcataaaccggatgcttatttcccgccgggcaaggagtggctatacagtaatacggggtatgcggtgttagcggttattatagaaattgtatcaggcatgagttttgctgaatttatgaaacaagccgtatttcatccgcttcgtatgcacgatacgcggatttataacagaaggctgagtaaagaaaacattccaaactatgcatatggctatgtgtatgatgttcattccggagaatatgtgctgccggatgaacttgaggaaaccgattatgtcgtctttcttgacgggattcaaggtgacggaaccgttaactccactattagagatttatatctgtttgatcaggctctttataaggaagaaatcatcggcaaagagtctaaagatcaagcgtttacaccgggctattggaatgaagaagagcaattcggatacggatttggctggatgattcaaaacagcgcccaaaaagggaaggttatcagtcacgacggaggctggccgggttattcaactctgatgatccggtatattgaccagaacaaaacactgatttatctcagcaatatggaacaatcgtatcaatttgaacaagctgtgattgccgcggccgtaaacatcttatttgatcagccgtacgtgattccgaaacgtccggcggatcagaaaaaagcagatatcgatcctgcgatttacagcagatttaccggcaattactcatttcaggatgacacacatgcatcggtgacggtaaaagaaaaccgattgtatcttgcaatagacgggcagacaccatttgaattattcccaatgacggaaacccgttattttgtcagggcgctgccgcttgaaattgaatttgcaggtgataaagcacaaactgccccgcatttcgttttatatcaggacggcacagaagaaacggctttgcggatagactgactgacatgcaaaacaaaaccgccgtcctgagaagacggcggtaatagaaaagtcaaacccctttaatgacgcgaaattttcttttcggctctgacataaatatagaagaaaaaatcatagctccgaccattgtgatgtattccatataaagcgaaacttctgccaaaaccaaccccgcaatcattaaaacagcgcccaataccaccgcaaaaaccttcgttttcatgatgagttcccctattatctgataattaaattatactgcatctctattaatgtgtacattttgtgaacaatttcacctgataaaaggcaataaagagagagttgaagaattaggagaaatgacaggccatctttttgttttaccgaagaaacgaaagggaaaatgaaaaatcaaaaaggcaaaggagttcttgaaatgaaagcgagactatttttattcagcatgtttctcctgatccccgttctggcgcttgccggatgcaacggtcaatcttcaggaggaagcgaaaaagcgaaagacaaagaaacgcactctcacgaagacatgaatcactcaggttcatccgaggtgccgaaaggtttaaagaaagccgaaaatccgacttataaagtcggcagtgacgtcatgattttagcttctcatatgaaaggcatgaaaaatgcgcaaggaaccgtaaaaggtgcttatgatacaacggtttacagtgtatcttacactccggaaacgggaggaaagcgcgtcgaagatcacaaatgggtcattcaggaagagctgaagggcgccggtgataaaacgttaaaaccgggtgacaaggccgtgatcgaggcatcccatatgaaaggcatgaagggtgccgaagccgttattgattcagccaaaaagacaaccgtttatatggtcgactatacaccgactgacggcggccaaaaagtaaccaatcataaatgggtgacagaagacgagcttgctgccgcaaaataaaaagaccgccaaagccgaaggaactcctttggcttttttgcggtctcacatttatgcggattttcttttcaaggcaggtctcgttaaagagaatacagctaacgcgacagcgataatgacaatcaaaccgccgcaccaggctgttgctgtgacagaaccggtttgtccgatcacgccgccgccgatggctgacccgagcgcgatgccgatctgcaaagcggacgtgttgaagctttgctgaatatcggaagactcaggcgcaattttgattaaatagctttgctgcgccggcgcaaggctccagctgagcaatccccagatcaccatcgcaggcaggaaaatgattaaagaaaccgttgtcagcggaagaataaacaggatcagagcgaaagaaacggtcacaagcatgatgcttttaaatgctcctaaacggtcatacagccagcctccgaacgggccgccgcataccgctgacagaccgaacaaaaagtagcatacactgacccaaacggaactcaaatgaagcgttctttccaaaaaaggcgcaaagtaggcatagagtgtgtaatgccccgccaatgtaaacaaggtgacaaggtgtgcgctggcaattttggcggtcccgatcgtcttgatctgctcacgaaacggaatcattttttcagcaggtattttttcgaaaaagacgctgataatcagcatggaaatgagagataatacgccgattcccaagaacagaacacgccatccgaaggcattgctgatgataatgccgacaggcacgcctaaagcgattgcggagctgaaccccatgaaaatgatgccgatcgcccgcgctctgtattcaggcgccacgattttaggagcaatcgttaaagaaaggacgacaatcagccctgtgctcatggaagcgagcacccgtgacaccataagaacggcgaaattgggactgaaataagcgaccagattacttaggaagaaaataaacagtgcgattaaataaagccgctttcgttcagcctttgccgtcactgccaaaagcagcgggccggataccgcgtaaccgagcgcaaacacgctgatcagctgccccgcgctgacaatggatatatctaagtcggaagcgatttgcggaagaataccgcccacaattaattcaaccaatccgactgcgatggtagatgctgcaagcagaaatactttgaaattcatgtacagatactcctttttttattttttagaaaataaaaaatcctgattacaaaaagtgtacgggacaatttttgtaatcaggattttacggttcctggtagacaccctcaaaccatatcattgaggttatacaatatattgcaatattcggttgtgtccgtttctgcaaaaaattctaccataatagtgagggagattccatagaaaattcgaggaaatcctttcaatttcaatatcggcggctgtaacgtcattgatgaagcagggaaaaaaatttatgataaccgtaaggagtctatacagatcaaacattacacagccggaggaaaccgatgaataagtacgaaaaaatcgccaacgaaatgagaaagaggattaaaagcagtgtatatgacatagatcagccgatcccggatgaaaagacgctcgctgcggagttcgggtgcagccggatgacgatgaagcgggcgcttgatacacttgcggctgaagggatgcttttcagaaaaagagggcacggcacatttatcattcaatcagccatgcaggatgagcacgttcacgtagtcagcaacgaaattctcggcttgagcaatttgttaaaaggcaaaaatatcaagagcaaggtcatccggtttgaagtgcagtttccgtctcaagatgtcgccgcacatttggctatcgatgaaaagactcccgtctattatgtagtgaggctcagaatcgttgaaggcgaaccgtacgttcttgaaaaaacgtacatgccggcgagccttatacccggcattaatgacgaggtgctcaaccattccatctacgatcatattacgcggggattgcagctcaaaatcgcgggcacacacagaaaaatcagagcgtgcaagtcggatgatatggatcagcaatatctcggctgccggccggatgacccgatacttgaagtcgagcatgtaggctttttggacaacggcactccctttgaatattcattttcccgccaccgtcatgacaagtttgtcgtgacctcagtcaatataaaacgttcataaaagcgccgaagagtgagagaaaaactcactctttttttgttgccgctgatttacatcgtcgcttcttttatgttatattacccaatgatagaatcatcctacaaatttcagaggtgttttgatggagatatccaaaacaagcagactgtcgctcgtagaacaagtggtggcgcaaattgaatcgttaattcaatcggataaatggccggtcgggacgcgcattccccctgagctggatttaatgaagcaatttgatgtgagccgaaacacgttgcgtgaggccattcgggcgctcgtacatgccggcctgctgcagacaaggcaggggagcggtacgtatgtcagctcatccagtgttctcggcgcggcattttaccgccatattaaaaaatcaaatttgcttgaaacattagaagtcagatacgcactcgaaagagaagctgcacgattggcggcggaaaggcgtaatgacgaagacctgaaagcactgaaggcatgcttggatgaatgtgaagcggccttgcaaaatgaagatcgaaaacggtatgccgaagccgacattaagctgcacaaaacaattgtacaggcggcccataacaatatgctttctgatctatacgagcatatgacggaggcgctttgtgcgtcagtccataacctgttggaaatcacccctgctatccggatccacacccagcttgccgccgcgattatcggacagaaaccggatcaggccatggaggccgtcaaccaatacatcacagtatttaaagatacaatacacatggaggatgaacatgaaaattaaagacgaacatcaagttctgcaagcaagtcagcgtaaaaaactgatattgctggtcatcggagtcatattgataggggccaacctcagagcgcctctgacatcggtcggaccgctcgtttcctcaattcgggacagcctcggcatgaccaatgcggctgccggcaccattacgacagtgccgcttttggcctttgcatgtctgtcgccgtttgttcctttattgtcccggcgcttcgggaccgagattgtcttactgtcatcattaattgtcctgacagccggaactctgctgcgctccatcgccggaatcggcactctctttttcggaacgatcctgttgggattgtcgatcgccgtatgcaacgtcctgctgccgagtctcattaaacataagtttcccggaaatttaggcatcatgaccggcgtctactcggtttctatgaatctgtgcggcgcgattgcatccggcatcagcgtgccgatcgcctcttcagcgggggtaggctggaaaggcgcgctcggctgctgggctatcctttcttttattgcgttcgtcatgtggattccgcaaatgcgaggacgcgaactgcccgtccgcacgactgggacaaacggagagaaaaaaaacagtctgatgcggtctccgctggcttggaaggtaacgatgttcatggggctgcaatcccttattttttacaccgtcatcgcttggctgccggaaattcttcagcagaatggactcagctcaagtaaggcgggatggatgctttcattaatgcaattctcagtcctgccgattacttttatcgtgccgatcgctgccgctaaaatgaaaaatcagcgcgcactcgccggactgacggctttatttttccttatcggcattgccggcgttcttttcggaagcccggctctcactccgctatgggtcattttgatcggaattgcgggaggctgtgcgttcagtctggcgatgatgttcttcagcctgcggacccggcatgttcatgaagccgcggcgctttccggcatggcccagtcattcggatacctgcttgccgcgttcgggccgcttgtattcggtttgctgcatgacatcacgcacggctggacggttccgttattcatgctgatcgcagtctctgttctgattttcattttcggagtcggagcgggaaaagcggaacagatcaaaacagcataaaaaaacaaaggacccgtttagggtcctttgttttttatttaaaaagctgtctcaggccgttacgctgtcagttttaagccgatgacaccgatgaggataagccccagagacaccaattgtgacagattgaatttttctttaaaccaaagtatgcctacggccgaaacgccgatgcttcccatgccggtccaagccgcatacgcgacacctgtgggaagaacctgcatcgctccggaaaggcaaaagaatgaaagcataaagcctgttaccatgacaatcagcggccacttttttttaaaaccgtcaatatgtttcatggcaacggccgctacaacttcctccgctccggcaataaataacagcagccatgccattaatgttcaccccttgtttcagtttctttcgtaaataccttcattcctaaaatgccggacaacagcaaagccaaaaagaatatttgtccgattgaaaacgattcgcctaaaatgacgcccgttacatatgtgccgacggtgcctattccgacaaaaacggtatatgcggcagccatcggaatttttttataagagcggatcagcatcagaaagctgacggcaatcaaaaggaaaataccaatccaatcaaagagcgaatccgcatgcttcagggcggacgcccaaactacttctaacaatccggctatcaatacaagcagccaatacatgatacagtcacctcagttatgaatgaatgtcagtcatttttacggcggtcaaaaatgatcggtctccgccaatcatttctgcaagcttcttttgagaaagctgaatatttcttttttatatacttcgagatcgacatcctgttcacagccgatataaaaccgttcagccgcgttctcgacaacgttgataatcgttctggccgtccatctgacatgaatgccgctgatgacctcaccctgttcaatggccgtattgatcatgccttccagccaggaataataaggctgataaatggcttcccatttctccattgaatgatcgatggcaagaccggaataacagagaacgataatatctttatgaagccgggtgatgtgaaatgtctcatctaccaaaatgtccagcaacgtccaaaaatcttcagaaccgtccgttttcccttttattctgtccagcgtagtgtcgagcaggttttctgcaatcgcggatatcagtgcgtttttagaagaaaaatataagtaaaacgtaccttgggccgttccggcttttttgacgatttctgaaatggatgctttgtctaatcctttttcagaaatgacttcaatcgcggcttgcaggatcttttcgtattttcccgagctttgttttgccaatagaggggttcctccttttatgaatgactgtcattcattttatcgcatgttcgcttttttgtcatcccttaacataaaaataccggaaagaagaccatacttctttccggcattcgtcatttatcactgtcgatcatagccttcggcagacctgtatattttgcccagtaataaataccgagcgaaccgatggcgatcagaatcaggtcaagcggattgctgataatgcccaatccgtggccgaacgagccgagataggagaaaatcagcatcatgacataaaagccgacgatccaccatgctgatttcagctgctggcgtatgctgacatcatctttgggagcatatttactgaaacagagatagatcagaaacatgacaatttgagaaccgagaagccaggatacggtgcgccatccggaccaatatacaatataagaggtaaaaataaacgacagcggcccgatgatgctcatcccttttaaataaaacggtctgttaatgttctttgcgttgactctcagcgccgcagaagaaatcggcgcaatcgcataagacagaatcaatgcgacggagcatacgttaacaagagcgttccaagaagggaacggaagcgtccaaaaaacagccagaccgaacgaaagccaaagggaggcacgcggtgtcccggtttctttattgactttagaaaaaatgctgaataatgttccgtttctggcccaggcatagacgagacgtgaagtcgtattcataaagatatttccgttaccgcccggtgataaaatcgcatctaaaatgaccaatgtcgccagccaccccaaaccgagcaagacggcgatatctttgaacggaagggagaattcagtcccgatagccggccatccgtgcttcagggtatccccgggatcgccccgataaaagtgagctgcagcacggtataaataatagtagaaacgataatacaaacaatcaatgcaatcggaatgttccgcttcggattctgcacttcactcgcgacagccacaatcggatgcagcccaaggtatgcaaacatgacgccgcctgtggaaatcgcggcctgaattccggtgaaaccaaaaggcgcgaatccgtgaacggtcatattgcccgggtgaaaatgaaaaatcagtacaacaattaccgtaatcggtacgacatatttaaaaatcgaaataatgaagtttgctttcgcaaaggttttgacactccagtaattgaggaggaagaacaggcagagcagcgcaaattgcaatatccatccggcaattgtcggagaatcagagccttttacggtcaaaccgggaaaccaatacgccacgtattggcggaccgccgttacttctatagaaataagactcgtgtatgccacaatggtgacaaaggaaattaaatatccgaccaggtgtccgtgtgaatatacgggataccggataattcccccggtccgcggcagcgcggcgcccagttccgcataaaccaagccgatcaataagatgattcccccgccgatcagccaggaaaaaacgcctgacgggcccgctttagaggcgacgttactgacggcaaacagccatgccgaaccgaatatggctcccatgccgattaaaataagatcaaaaagtgacatagttttctggaagtttccttgcttagacattcgctgcctccttaaaaaagacattgttctctttacataattcccattatcattcaaacatacccagccggccggctggaaaattaggacaactttcgaaacgaagtatgtacagaaatgtgctcacatcaaaatcacggccgtatggcaagatctcccggcttatattccccgttttgaacacattcaaacctcatattcagaaaaacaaaaaacgcccgaaacaggcgttttttgttacaagttcatatctttcagtccggggctgtgctcattcggaagctcgggaagttccggcacggggaaacctttaggaggctctgacacacttaattcgccgccgtttcggctcggcgtcgttccctgcagaatttctccgatccgtgtcggatccagtctgaaattaaattgggtattatgataacccatttcaacgaatttccggcattccgggtatttttcaatatcataattcggcacgggaaataatttgccccattcgacacccagtgtttccagcgcttttgtaaatgcattttgatgggcgttgtcacggacgatcagaaaaccgagtgtttctctgaacgtctggtttgagctcatttcataaatgcgcgtcttttgcagcacgccggttgattccagcacgacattgtccaatagatcggaaatcagattcccgtggttgtatacccaagacccgttccatggattgccgcttgcatcggcaggaagagaactttgcgccccgataatataatggtgcggattggcgtgtttaaccgcttcgtctagcggcgcctgatctgctgcctgatttccggcgccctcagcgccgctttcatccagcagcgcattaatcgtatgctggacgagctcaacgtgtgcaatttcttctaaaaatacgccgcgaagcaggtcgcggaactgcttttcttttcctctgaaattagagctttggaaaaagtattgcatcatcgtccgcatttccccgtaatgcccgcctaaaatttcctgaagcaccttggccgcggccgggtccggcttgtccggtttaatgatattgatcagctcttctttgtaataatacataaacagcgcccctgaaagaagttttcggttcttctgttagtgtctttgcaaagtcagtttttatgtatcggcatcaaaaaaaggacggaaagcgtgtccgtccttttgtgttaagcctcaaccgccccgcgaagtttcgtgttgacaagcccgttccatccttgatccatcgtactgtgaatctcggagcttttccgattgactttattgatgacggcttccggctctttccatccgccgtgaatgagagtgaattccgtatctccgctttccgtttcctttaagacaaaagagacgatccagccttccgtatcccacgaaaaagaaaggcggtacggcgcttcaatatccagcagcttgcacggagacggaccgaacggagattccagctgaaactcactgtcttcttgaggcgtgaaatcattcggcataaaccagagagacaggccgtccgccgtagagaccgtatcccagacaacttgtatcggcgccttgaaaacggcggtatgaataatgtccggtaatggctgattgctgttgttgtttttgttatctttgttttgtttatcagacatgatgcgtaaccactctttcgctgtttttacttttgatcatactacacagggcaggacatttgaaaacaaatcaaacttattttatgcttttccaaagccattcaattcattttaaggagacgtagtgatgacagatcaatttaaagcgttagtagtcgatcagcgtgaagaccggttttcagtcagcgtacgggagctggcggttcaggaccttcccgagggtgaagtgctgattaaggtttgctactcaggggtgaattataaagacagcttggctgccattcctgacggcaagatcgtaacctcgtatcctttcgtgccgggaattgatttagcgggaatcgtcgtttcttcagatgacgcccgttttaaagaaggggacaaagtcattgcgacaagctacggcataggcgtttcccattttggcggctatagcgggctggcccgcattccggcagattggatcgtgccgctgcctgaaggtctgacacttaaagaagccatgacgatcggaaccgccggcttcactgccgcattgtccgtccagcgtcttgaagaaaaccatgccgctcctgaaaaaggaaaggtgctggtgacgggagcgacagggggcgtcggaagctttgccgtctccattctttcaaccttaggttatgaggtcgaggccagtacgggaaaagaagaagaaagcgggtatttgaagagcctcggagcaaagacggtcattcaccgcgacgaagtgtataacggcacgttaaaaccaatgcaaaaacaaaaatgggcagcggccgtcgatccggtcggaggtgagccgcttgcttcagttctcagtcagattcagtacggcggatcagttgctgtgagcggactgacagcgggaacgaaactcccggctacagtctttccgtttatattgcgcggcgtcagtctcttgggaattgattccgtattctgtccgatggagacaagaaagaaaacatggcagcgtttagctgatgacttcaagcctgcagatctggaggcctttattcaaaaggaaattacacttgaagagctgccggatacgcttcctgcccttttaaaaggagaagcgagagggagaacgattgttacaataaacgaagaataaaacaaaaacccccaatcagcagttgggggttttcaatatgtaatcaattattgattataataggggtaattaattgagtatattatggaaataaattgatataaaacgaaaattgattatatataggtgatataaaggtgagttataaaattttctgaaatatttattgactgaaagcgcttttaaaattatgatattaacataagtaccaataatatcattataacttcactacaaagtaactataaaataacaatatgacgagagggggagagcgaataatcactataaatgataacgctttcggaacattttcttcttatataactgttttggacggtcagaccttgtatgcagacgttagaggtgtaaatattgataactgaatattccgatattatctctgtgtaaaaactaggaggatttgaagatgaataaaaatagcagccagcattcatttttgagaaccatcattttagtatcgacattcggggggcttcttttcggctacgataccggtgtgattaatggggcgctgccgtttatggcggaagctgaccagcttaatcttaccgctttgactgaagggatggtggcgagctccctgctcttgggcgctgcgatcggcgcggttttcggagggagattgtcggactataacggcagacgtaaaaatatccttatccttgccgttttgttctttatagcgacgcttggatgtacactggcgcctaacgtatcggttatgatcatctcccgttttctgctggggcttgccgtcgggggagcatccgtaaccgttccggcatatttggctgaaatgtcgccggcggaaagccgagggagaatggttacccaaaatgaattgatgattgtaacgggccagctgcttgccttcacgtgtaatgctatcatcggcaatgtgcttggtgatacctctcacgcttggcgttatatgctcgttatcgcggcccttccggcggtattcttgtttttcggtatgctgaaagttcctgaaagtccgcgctggctggtttctaaaggaagaaaagaagatgctttgcacgttctccggcgaataaggaatgaagagaaagcgaagtctgagctcgctgagattgaatctgcctttcataaggaagctcagatggagcaggcgacctttaaggatcttgccgttccgtgggtgcgccgcattgtgtttatcgggatcggaattgcggtagtgcagcagctcaccggcgtgaattcaattatgtattatggaactcaaattttaaaagatgccggttttgagacaaaagccgcattaatcggcaatatcgctaacggtgtgatttcggtgctcgcgacttttgtgggaatatggcttctcggcaaagtcggccgccgcccgatgctgatgacggggctgatcggaacgactgcggtgctgcttttgatcggagttctgtctgtcgtgctgaaaggatcgcctgctcttccttatgtggttctttcattaacagtcactttccttgcgtttcagcagggggctgtctctccggtgacctggctgatgctgtcggagatattcccgctgcgattgcgggggcttggtatgggggtgactgtcttctgcctctggatcgtgaacttcattgttggtttaacttttccggtcatgctcgcaaacatcggattgtctgcaaccttcttcatttttgtcctgttagggatagcgtccgttatatttgtgaaaaggttccttccggaaacgaaaggtctttcgctcgaacagcttgaacaaaacttccgtacctatgaaaaaacagatcgtaatagcgcagaagccgaggtgagcgggtaatctgaatagacgcggggttcctgggaatcctgctttttatttattatatagaagggaataataagcggaaaaaaagtttcgtaaaagtgttgacctaatttaaagtgcgtggtatattattaaacgtcgctgatgaacaaagcgataacgacaaatgagaaaatgatctttttaaaaaagactttacaaattctcgaaagcgtgtataataaatgaggtcgagaaaaaagacttcgaaaagaaataaaataacacttgacatcataactgattggtagtatgatagttaagtcgcctgataagcgcccgtagctcaattggatagagcgtttgactacggatcaaaaggttaggggttcgactcctctcgggcgcgccaattcaaatgcgggtgtagtttagtggtaaaacctcagccttccaagctgatgtcgtgagttcgattctcatcacccgctccattataatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagaccttgggtcttataaacagaacgttccctgtcttgtttagttttgaaggatcattcgattcttcgagatattgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatgggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaacactctcaatggtttggtggcgatagcgaagaggtcacacccgttcccatgccgaacacggaagttaagctcttcagcgccgatggtagtcggggtttccccctgtgagagtaggacgccgccaagcttttctaaaattttatcatcgcggggtggagcagttcggtagctcgtcgggctcataacccgaaggtcgcaggttcaaatcctgcccccgcaaccaaaaattaaatggtccggtagttcagttggttagaatgcctgcctgtcacgcaggaggtcgcgggttcgagtcccgtccggaccgccatttttattgtaaacgaaacgatcatgttttcgttttttttgtgttttcttttaatgctggcagcttggtatctaaccaagctttcttttatatcgttaaagtcttggatattgaaacataatccgatacactagaaagagctgtatttcacaagagcgtcagaaaggaagacgggagatatatggatgagtttgatttgattcacagtattacaccgcattcgcattatcatccttccgtcgatgtagggatcggtgatgatggtgcggtttatacagcgtcaccccacatgcagcaaattgtctgccttgatacaatggtggagaatgtccattttaaattagagtattcctctcctcatgatatcggttataaggcgcttgctgttaacattagtgacgtggcggcgatgggaggcattccgaagttttatttggtgtctctagcggttccttcttgctggcagaaagctgacgtccaggcaatgtatgaaggaatggcggaactggcgaaactatatcaaatggatttgatcgggggagataccgtctccgcttccggtcaagccgtaattaccgttactgtcatcggagaagttgagaaggattgcgcttgtctgcgaagctcggcaagacccggggatgttgtgtttgttacgggggatatcggctcgtccgcagcaggactgtctcttttgttgggagaaacacatccttctgcttttcatacgagtgattattttatccaaaaacataaacggcccgttccgagagttcaagtcggccgcttctgctctcagcttcagcgcgcggctctgaatgatatcagtgacggattggccagtgagctgcatgaaatagctgcggcaagttcagttacgatagaaattgaagaacaacttctgccggtgcatccggatttgcctgaggcagattctgagtggaagaaatgggtgttattcggcggtgaagattttgaattggttggaacggtttctcagcaagagtggacctctctgcttgattactgcactcaatcgggcattccgattgcgaagataggggcggtatctgaacggaaggaagcatgtgttcttttgacagccaatgatcagagacaaatcgtccttgagaaaaaaggatacaatcattttaaataagacgggtgactcactttgaagacattacaatggagaacgaaaaaccccgaagaaacgaaagccgtagccaagcttgccgcttctttggcaaagccgggagacattttgacactggaaggcgacttaggcgcgggaaaaacgacttttacaaagggttttgccgaaggactgggaatcacgagagtggtaaacagcccgacttttacaattataaaagaataccatgacggttcgattcctctatatcatatggacgtgtatcgtatggaggatgaaagcgaagacttagggcttgaagaatattttgagggacaaggcgtctgtttaattgaatgggctcatttaattcaggatcagctgcctgctgaacggctgcagatcgtcatcaagagagccggtgatgaggcaagggacattacctttacggcttgcggaacacggtatgaaacgctttgtgaggagataaataaacatgacaatactggcaattgatacgtcaaattacacgctgggtgccgcgctcgttcgagagaaaacggtgatggcggagtatattacatatttaaaaaagaatcattccgtgcgggcgatgcctgctgtcaattcattgctgaaggattgcggcctaacaccgcaggaccttacgaaaatagcggtggcgaaaggacctggatcgtacacaggtgtcagaatcggtgtgacgctggcaaaaacattggcatggtcgctgaagcttccggtttccgctgtctcgagcctggaggtgctggcggctaacggacggcactttcaaggactgatctgcccgttatttgatgcccggcgcggacaggtatatacgggactttatgaatatcaggacggccgcttacaatccgttcttcctgatcagaatgtgcttttgactgattggctcgacatgctgaaagaaaaagcgtctccggttttatttttagggcatgatacagccattcatgaagaaaccattctgcatgggctgacaaatcaagcagtgataggaacggctgcacagcataatccgcggccgtcagagctggcgtttttaggcttggaaaaagaagaagcggatgtccacagccttgttccggattatttgcgtctggcagaggctgaagcgaaatggatggaatctcaaaaatagggtgatagggatgaaaacgaaaacggcgattcgaagcatgcggccggaagatattgatcaaatttatgaaattgaaacagcatcctttacttctccgtggacgaaggattcattttatcatgagcttttggaaaatccgtatgcccactaccttgtcattgaaaaggacggctgtctggcggggtattgcggaatctggattattatagatgacgcgcagattacgaacatagccattaagccggaatatcggggccaatcgttgggagaagcgctgtttcgctctgcgatagaattgtgcagagaaaaaaaggcaagaaggctctctctcgaagtcagggtctcaaatcatcccgcccaatccttatataagaaattcggtcttcaggccggaggaatcagaaaacaatactatacagataacggggaagatgcgttattaatgtgggtgacattacatgagtgaaaaacaagatatttatgtattaggaatcgaaacaagctgtgatgaaactgcggcctcagtcgtaaaaaacggaaaagacatcatttcaaacgttgtcgcttctcaaattgaaagccataaacgtttcggcggggtcgtgcctgaaatagcgtccagacatcatgtggagcagattacccttgtgattgaggaagctctttcaaaggcggagatgggctttgatgatcttgatgcgattgccgtaacggaaggacccggacttgtcggagccctgttaatcggggtcaatgcggcaaaggcgttaagctttgcccatcaaataccgttagtcggcgtccatcacattgcgggccatatttatgcaaacaggctgataggagagcttcagttcccggcgcttgctttggttgtgtcaggcggacatacggaattggtttatatgaaagaacacggttcattcgaggttatcggtgaaacgctggatgatgccgcaggcgaagcttacgacaaagtggcaagaacgatggggcttccttatccgggagggccgcagattgataagctggctgctgcgggaacggattccattccgcttccgcgtgcgtggctggaagaagggtcttacaatttcagcttcagcggcctgaaatcagccgtgattaacacgcttcataacgcctcgcaaaaaaatgaggtgattcctccggaggatcttgccgcaagctttcagcagagtgtcattgatgtactgacggcaaaaacctctaaggccgcgaaagaatacagggttaaacaagtgctgcttgcagggggcgtagccgctaacaaagggttgagagccgcactgcagcaggaattcagccattcgggagatcccgagcttgtcatcccgccgctttctttatgcacggacaatgcagcgatgattgcggctgccggaaccgttgcttttgaaaaggggatccggggctcgtacgatatgaacggacagcccggtttggaattaacatcctttgatcgtctcacgttgtaaaacgtgaggcttttttttacttattaacagataattctaacatatccacaggattgtgaatatattcagaaatccagtctggataagggactgaaagttgttagtaaagtggataaagtcagaaaattttgtggatagtgtgtataaaacgcttacttaaatggctgacaaggaggatagctgtggataaaaaagcaccccttaaagaggtgcttgactttttctattcttctgaggagagttcctcccattctgctaataagttttcgagcttttgattctgggcttcattctccgcgtgaatggtctgtactttttcatgatcctgatacacgtcaggatcgcacagcagctcctcattggcactgattttctcttcggcggatgagacggccgcttcgatttcttcaatgcgtctcaggcgctgccgttctttcttcttccattctttttcttcctcgtaagttcttttcgtatcctgtttgaccttgccggcaggctgagtctgctccttttcctgccgcttcatttcttccagttccagctgctgtgcttttttctcggtgtaataatcatagtctcccaaatattcttctgcatgatcaggtgacagctccagcactcttgtggcgatcctgttaataaagtagcggtcatgcgatacaaataacagtgttcccgggtagtcgatcagggcgttttccagcacctctttactgtccaggtcaaggtggtttgtcggctcatcaaggatgagaaagtttgctttttgaagcatcagcttggcaagcgcgactcttgctttctccccgccgcttaacgaacggaccggtttcaggacatcgtctccgctgaacagaaagttgccgaggcatgttctgatttctttttccggcatgtccggatattcatcccacagctcgtccagcacgcgtttggacgatgtcagttcagcctgctcctgatcgtaatagccgattgtgacattggaaccgtacgtgatcgacccggattccggactgattgtattcataatcgttttcagcaaggttgatttgccgattccgttcggtccgacgagggcggcgctttcgcctcttgtaatgccgaaggtcaggtttttcaagagcggcggctggccgtcatagctgatggaaagatcctgtacgcgcaggacgtcgtttccgctctgttttgtaatgtcaaaacggaaggcggcggatttctcatccccgagcggctttgccatgacgtccatccgttcaagctgttttcgtctgctttgggctcttttcgttgtagaagctctggccagattgcggtcgacaaaatcttgaagcttggcgatttcgtcctgctgtttttcatacagcttcaggtctttctcatactgctcagctttttgttctaaataggcgctgtagttgccgaggtattttttgctttctgtccgtgagacctcgtacacttggctgacgactttatcaagaaagtatctgtcgtgggaaacgatcaggattgcgcctgaatatccctgtaaataatgctcaagccatgtaagcgtatcgatgtcgagatggttcgtcggttcatccagaataagcagatcaggctgggtcagcagcagttttccgagcgcaagccttgttttctgaccgccgctcaggctttgcactttcacggaatcgtcaaattttccgaagccgagtccgtgaaggatagatcggacgtccgcttcatattgatagccgcctttatccttgaaatcctgctgaagcctgtcataggttttcatcagcgtttcaagctccgcgggggcggccgtggccatcttttcttcaatagagcgcatctctttttccattgctttcaggaaatcaaaaacgctcagcagttcttcttttatggtaagctgggattccaagcctgtgtgctgggcaagatatcccatcgttaattctttcggtttgattaattcacccttttcatatgaaaggtgacctgcgataattttaaggagagttgatttgccggctccgtttctgcctactatggcgatgcgatcccgagatctgacttcaagctttatattgtttaaaataggatcagcgccaaaagatttggatagctgattaatttgtaagatcatcatattatttcacctctgttataataagttaagtgtagcttatcaacctgctgtcagcaaacaatacatcagaattggaacattataggataagacatcagggagaaaatagtgtatgatcagaagtaaggagagtttaaatatgaatggattttctcattttaatgaagaaggccgtgcccgcatggtggatataagcgataaatcttcaacagtccgtactgccgctgcgatatccagcgtacacatgaagcatgacgtgtacagcagaatcaaaaaccgcgagatcggaaaaggagacgtgctggctgtcgcacaggtggcaggaattatggccgcaaagcagacgtcagcgattatcccgatgtgccacccgctttctttaagcagcgtcgacatttcattcggctgggaggaaaaggattccgaagccgttcttcatatacaggcaagcgtaaaaacgaaagggagtacaggtgtggaaatggaagcgctaacttccgcttcagtctgcgctttgaccgtgtatgacatgtgcaaggcgctggataaaggaatggtcatcggcccgacctgcctcatggaaaaaacaggaggcaaaaacggtgattttaaaagagatgcatctgagtataaagtggaggaccaatcatgaacaaggatcaatcaaaaattccacaggcgacggcaaaacggctgccgctttattatcgctttttaaagaatttacacgcgtcaggaaagcagcgcgtttcatcggctgaactgagcgatgcggtaaaagtcgattcggccacgatccgccgggatttttcctatttcggggcgctcggcaaaaaaggatacggctataatgtggattacctgctgtcatttttcagaaaaacactggatcaggatgaaacgacgaacgtcattttgatcggtgtcggaaatttagggacggcgtttcttcactataatttcacaaaaaataataacacaaaaatatctatggcttttgatgtgaatcagagtaaaataggaactgaggtaggcggtgtgcctgtctttgatcttaatgatttagagcttcacataaaggatgaacccgtggcgattcttaccgttccggcggttgccgcccagtcaatcaccgaccggctcgtgtcactcggaatcaagggaatccttaactttacgccggcccgtttgaatgtgccggatcacattcgaattcatcatatagatttagcagtagagcttcaatcattggtttatttcttaaagcattattctgttttggaagaaattgaatagcgaaaggaggagctgcacatgatcggtcctggaagcctggcggttatcggtgtggtggcggtgattattttcggtccgaagaagcttcccgaattaggaaaagcggcgggggacacgcttcgtgaatttaagaacgctactaagggattagccggtgaagaagaggaaaaaaagaaagaagaacagtaagataggatgacgcgtatgagagtgaatcaaatgacgcttgtggagcatattgccgaacttcggaaacgattgctgattgtggcgttatcctttacggttttctttattgccggcttttttctggcaaaacctatcattgtgtatcttcaaaaagccgatgaagtaaaagagctcacccttaatgcttttaacctgacggatccgctgtttatctttttgcagttcgcgtttatcatcggcatcattttgacttcgccgattattctctatcagatttgggcgtttgtcagcccgggtctgtatgagaaggagcgcaaagtaacactcagctatattccgatttcgatcgtgctgtttgtcggcggtgtgtcgttttcttattatattttatttccgctggtcgttgattttatgaagcgggtctcgaatgacctggatgtcaaccaggtaatcgggattaccgagtactttcattttctgctgcagctgacgattccgttcgggctgctgtttcagatgccggtgctgatcatgtttttaacgagactcggtgttatcacgccgaggtttttatcgaagatcaggaagtacgcatattttgtgctgctcgtgatcgccgcgatgattgcgccgcctgagctgctgtctcacttgatgattaccattccgctttgcattttatacgagatcagtatcctgatttcaaaagcggcgtatcggaaaaggcagaccggcagtgaatctgaccaggacgtatcagcataaaaaaagccatttctcaatgatgagaaatggcttttcttttattatttttggtttttcttcactttaaatgagaaggcgaacattttaaacgagatgctgatattataagcggcgaaaaccatcagcagtatggaataaaaagaccacatgcttcccggagagcttgcggccaaatacgtaaagatacagccgactgcgaaataaatcaagccccaagtcattgggttcctcatacaaacaatcctccaataattaattgcatttgctcactatgctgttcaatatatttttgggcggggccgagctgcatgaccacgacaatggtattcatcatgacatgggcgaatatcggcacaataatccgtttcgtctgcacatacaagaacgcaaaggtaaagcccatggccgtatacagcagcaggtgcgtgaggtcttgatgcacaatgccgaaaatgacggaactgatcagtccggcgataaagaaattcgttttttcatataatacaccgaagatgatcttccggaaaatgatttcttcaagaatcggcccgacgatagaagaaacgataatcatgagcggcatggctttaataatgttaagaatggctttcgtgttttcggaaccgctgcccacatgaaagacatactgctcaatcatcccggcgattccctgagaaaataaagcgagccatattcccgcgaccgcccagagaacggacatgccggcggatgctttcttcccgtttcttaatgtctgtttcggcgcggttctcaaaatcaagagaacgataatcaggcagataaaaaagcttacgacggaataaatcccctgagccatggtgagattcgcattcgtagggtgcccgcccgcatagccgaatttgtacattaaaggaatgccgatcaatgcggaaagctgcatgataacatatgtcaaaatgatataccaatactgttttctcaaatgatatgtactcctttatcctataaaatcaacttatttgttcttattgtaacacaagtgaacttgacgtgaaaaaaggagaaaatcagtgcgagagagaatcatgtaagcgtgaaaattttttattcttatgacttgaaattggaagtgagattctttattataataactgtgttagcactctttagagctgagtgctaaaattacatattcatactattgaggaggttattacattgttaaagccattaggtgatcgcgttgtcattgaactcgtagaatctgaagaaaaaactgccagcggaatcgtattaccggattctgcaaaagaaaagccgcaagaaggcaaaatcgtggcagccggttcaggtcgcgtgttggaaagcggagagcgcgttgctttagaagtaaaagagggcgaccgcattatcttctcaaaatacgccggtactgaagtgaaatacgaaggtactgaatacttaatcttacgtgaaagcgacattttagctgtaatcggctaagcaaataaatatttttaaaaattcgaggaggtttcgttaacatggcaaaagatattaagtttagtgaagaagcacgccgcgctatgcttcgcggtgtcgatgcgcttgctgacgctgtaaaagtaactttagggccaaaaggacgtaacgtggttctggagaaaaaattcggttctccgttaattacaaatgacggtgtgacaatcgcaaaagaaattgaacttgaagacgcgtttgaaaacatgggtgcgaagcttgtagctgaagtagccagcaaaacaaacgacgttgccggtgacggtacgacgactgcgactgtacttgcgcaggctatgatccgcgaaggcctgaaaaacgtaactgcgggagctaaccctgtcggcgtacgtaaaggtatggaacaagccgtaaccgtggcaatcgaaaacttaaaagaaatttctaagccgatcgaaggcaaagagtctatcgctcaggttgctgcgatctctgctgctgatgaggaagtcggaagccttatcgctgaagcaatggagcgcgtaggaaacgacggcgtcatcacaatcgaagagtctaaaggcttcacaactgagcttgaagttgtggaaggtatgcaattcgaccgcggatatgcgtctccttacatggtgactgactctgataagatggaagcggttcttgacaatccttacatcttaatcacagacaaaaaaatcacaaacattcaagaaatccttcctgtgcttgagcaagttgtacagcaaggcaaaccattgcttctgatcgctgaagatgttgaaggtgaagctcttgctacactcgttgtcaacaaacttcgcggcacattcaacgctgttgccgttaaagctcctggcttcggtgaccgccgtaaagcaatgcttgaagacatctctgttcttacaggcggagaagtaatcacagaagacttaggccttgacctgaaatctactgaaatcggacaattgggacgcgcttctaaagttgtagtaacgaaagaaaacacaacaatcgtagaaggcgccggcgacactgaaaaaatcgcagctcgcgtcaaccaaatccgcgctcaagtggaagaaacaacttctgaattcgacagagaaaaattacaagagcgtcttgcgaaacttgccggcggcgtagctgtcatcaaagtcggcgctgcgactgaaactgagctgaaagagcgtaaacttcgcatcgaagacgccctcaactcaactcgcgcagctgttgaagaaggtatcgtatccggcggtggtacagcgcttgtcaatgtatacaacaaagtcgctgcagtggaagctgaaggcgatgcgcaaacaggtatcaacatcgtgcttcgcgcgcttgaagagccgatccgtcaaatcgcacacaatgcaggacttgaaggatctgtcatcgttgagcgcctgaaaaatgaaaaaatcggcgtaggcttcaacgctgcaaccggcgaatgggtaaacatgatcgaaaaaggtatcgttgacccgacaaaagttacacgttcagccctgcaaaacgcagcttctgtagcagcaatgctcttaacaactgaagccgttgtcgctgacaaaccggaagaaaacgccggcggcgcaggaatgcctgacatgggcggcatgggcggtatgggcggcatgatgtaatcaaacggaaaaaacccttgatacaccaagggtttgaccgtttttcatcaccccaattaaccgaaaaaataacaaaaaaataacatttctttatgaaatcccgaaattgaggatgtttccaaaagtctgctggactttgtgggaggcatcctctttcatttttttggttacatgagtataaatcttcatcgttgttttcatgtcgtcatgcccaactctttccattacagttggcaagtcaacttttgcctcggccagcatgctgatatacgtgtgtctaaatatatggggagtagcatgttttttaattgatgttttttccagtattctttccattcttacaatgatattttttggtaaaaagggatagccattctcacgagcaaataggaaattaccgtcgtggtattcgcttggatcaatcctggactgtaggcgcaacttcttttgtttggttacatgtgccttcaatatatctattatctgatcgtcgagagtgatagttcgcaccgatccggctgttttcggcggagttaattcataatttctcatattgttatcttcggaatatatggttttagtgatacgcagctcttttgtttcaaaatttatatcaggaagtttgagggcgcacatttcccctgaacgcatgcctgtaaaagcgagcaagtaaaatcgttcaaggtccatttccaaaccatggacttttactgctaagaggaactcttcaagttcttccctttcaagatatttttgctctattttactactttcaatatcttctactgtcattctctttttaggaactacagcgccagccactggattatcttttaaaagcttcacctttacagcgtatttaaaaatcattccggctgtcgtatgcacaccactaatggtggtacgggcatattcttgatcagtgagatcgttgagtattttttgatattttcttcctgttacctgagcgatattgattttagcgatataccggtttaagatgttaatttctttccttcgaatacgcagagttgcttttttctttcctgtgagagcatattcgttcaaccattcggcagcaagcttttcgaaagtcatttttttaacaactgattcatcaatgccatcttcttttaaggcatcaatagcatctctaactctttgttcagcttctttttttgttttgccacgccgcgcaatttgtttgcgtttaccggtaacgggatcacgaggtccgtcaccaacagccagccattttttacccttgatcaattcctctgtatacattttgtcaccccaatttttcaatgaatagttttaaagagctgtttatacatcaagaatgagaactgttttcttgtatacatatcgagccgtttagcagcaaattgatatgtaacattaaaggtatcacctattaattttataacctctgatttcatgcgtggcaacgaaatcttttcaagcataaaactaggtacacagaaatgatacataaagctattagcctgatactcttgcaactggcgaaacatacgattcatgttgaactggtttccgcaatgtttaatcacatgccctagctcatgaacaaagtcttgccactgttcttgcggagaggctcgagcatcaaggacaacgctatactcaccgttaatttgaaacatgcagctttctctttgctcataatgcagccagatacgaaatgccgcggcaatcctttctaaatcaatgtcttcaggagtctcaatatttaatttgtaatagatttttttcacttcttcttcaagatacgataactggattgacattaaaaacaccaccatgtagggaatgtatgttctgtttttggtgtgaaagaaaagcccgaggaagaagggctgtcataaattcaatagctgtttctttttaatttcatattcttcttgagtgatagcatccatatccaacaattctttatattttttcaattcatcagctgcagatacagtaggggcaggagctggtggtattgttggagctggaatagactgatgttcttctatgtatttttgaatttctaaaaccataggcagttcatttgcgccaaaagtgaaggagttatcgtcttgtattgcgtcccagagtccacttgtttcattagcagctggcgttaaaaattgaaaatagcctgaggttactaatccaggtttttttatttgaagcccggacagttcactgattctataagatttctccccactataccctcgtgtgatagtgttaacagcgccttttcttgctactcttatatagtttccatcaagtgtgattgttgtttttgctgatttaaaatagtattctttagtttctttctttaaatcctctttttcactttcgtatctttcctcattgccagagatttttgattcaacatatttgataaagccgtcaatatcaccttctgatattgaattgatgtttaagtcttcttcggctgttttaaaatcaatcttatgtccaattaatggcttgcgactggcagtaattttaattatttctttatagggccaattctttaaaattggttttttctttttcaagacaatgaaatatacttgattttctgtagcaataaaatgcccccatgtcgcgtcactcttcatagttccgcaaacgagttcatgaattgtttcatttctttcatcaatcagaggtttagctgcttcataagttttcaagaaatttttagaagccttcatgcgttttttaaactgacagttatagatttcgccattttccatcaaaaaagacaaatttaatttcccctttataagtaatacacttgagtatatttttttctgatcagatcccgtttgaatccagatgcaatccagatgagaaagaattctatttcccttgatataattggcttcaacctactggtgaaaaattcttttccgatccagttcggttctaatcccgatccaatcctgatcttattagtaaacagaaataacataataacaataatataaataaaggtttcggcagttagttactttttaggcttacggccttcacgttcttctttctctttgaggtactttataaaatcaattgcttgtttttgtctttcttctgagaagtcactcgcttctctaaaggcgatctgtagatcaggatcatcaaaaaggtcattattaaaagtaggttctttgccagttaggagataatcagttgttacaccatacaaacttgcaagtctaacgagcatttctccatctggtttccttaaaccgtattcccagttcgcatatgtagacattgttttaatacctaatttttttgcgacgaaagatttgctccagcctttcttttctcttaattcagttaagattttccctgttatattatccattattatacacctttttttatttggtgtgtaaattttaacacggtttacacacaagagataattacttacacaaaaagaataaaaatatgttgacttacccttattgtgtatattattatgtatttaacgagttacacgaaaagagtaaggtggtgagttaatagtgctagaaaaattacgggctacaagactttctcaaggaaagacccaaacttttatggcaaaaaagcttggctatagatacgcaagcggttatgcaaatatagaaatggggcgtacaaagccaagtcttgaaaaagcacaccaaatatccgagttactgaatgaagaagtcgatgagcttttttttaatgaaaagttacacaaaaagggtaacgagaaaactgcttaggaatgaaagttacaaaaaaacagtataggaggtcgaagttatggatcaaaaaaagctggaacaaattaaaaatttgttgaatggtatgtcccaatccgagtggagccgtgttaaacaacatgtcgatgtactgttcagttctaaagccgccaaattgcagtttgacgacccagaactgttagaagctaaccttaaacgtgaatttaggatgaatacttgatttggataaacattgggtgaatgcgatattcagcatttttgtaataaatattaacgtaatcttgctgatacatcgtgtgctcttctttagaattagggctccaaattgaagcaccttcttcccaccatatgtatggagaagacatagattcacctattttgcagtccggatcactagtcaagtcaacccattcaccacaaaggcaagcgtaaaccttagtagaagccattaaatctcaccaccttccatgcatattttaccacatgaaagtgagagattataaagctcattgtaaaggaggttttttatatgttcactatgcaatacgatgagaaattcattgaacagatagctgccaaaattgctgatagagcaacagacatgctggtagagcggctcagctctttgaacgagcttcctcacatcttgacgagaactgaagcgatggaggtgctgcggtgcggtcccactaaaatggcggaactgatggcccgtccggattttccggttaacgaagaatgtggcaaaaaaatccctacgactttgctttttaaatggattgagagcaacacgcgttgggttgctgagaacaccgcatactatcagaaaggagcttcggcatgaataatttacaaacattcaaaaatgaaattttcgaagttgcagccaaaattgagaatgatcaaatcctttttgatgccgagcaagttgctcggaacttaggcctcactaccgttgccaaaagtggcaacgtaacaatccgatggagccgtgtgaatacttaccttccggataactttccagaagtagagaaaggtgattttattcctgaaccattggtgtacaagctggcttttagagcatctaatcaaattgccgaacaatttcaagattggttagcctttgaagttatacccacaatcagaaaaaccgggggatatgtcgcaaatgatgaacagttcattcagacgtatttgtccaacgcagacgaaaataccaaattatttttcaaaacaactcttcacgcactaaaggagcaaaataagcaaattgaatctatgaagccaaaagctcttttcgccgaagccgtggaagcatctgaatcatctgtgcttgttggcgagttagcgaaaatcattcaacagaacggcgtaaagattggacctaacaagttatttcaatggctccgtgataatggttatttaattcgtaagacaggcgagtctttcaatctaccaacacagcgaagtatggatttgggtctctttgaaattaagaagagaacaatgaataaccctgatggttcaattagaactacccgaacgccaaaggttacgggaaaaggtcagatttattttgtgaataaattcatttcatcagaaacagcttgaaacaatctccacaaatttggggagattaatgttcgagaaaaggactagcttgtcccttcattaattaaattttaccagtgaacaactggatatatcaggaggcaaacatatggagaacaacccatacaatttgcataatctaccccggatcatgcgtagtgtccgcaaagcggcaggacttgcacagtatcagatcggtaatttgatagggggaaaggatcagcgatatgtttcggacgttgaaaatggattcagtaagcttaccccggaattatgcattaagtggtttgaggcgtgcgaggcatacgaacatattgatctggtacattatctcttcaaattgcacccgacgacggcggcgccaattgatccagcacttaacgagagtgcaagcgcggcggtaatcaatatgattcaccagcttgaagaagcattacaagcaacaaggcatttagcgcgctggttggcaaacgataggccaggccgacaacctgaagaactgcccatggccgatataaagcagatttttgatctgatcccagcaaataaaacgctgatatattcgctggcccgtagtcatggactgaacatgaaggaactggccgaaaggtggacgcggaaagcgctaatgagtcaggttgcaatggcgaaaacagaagaaaggcaggcggtgctggtatgaaaatcaatcagtttcttaaagcagatgcagattcagcaaaaaggaaaatcgagtcggcggaaaggctctctatcatgcttgcggaggcgttgcgggatggcgattatgaagaagctatcagtcttgcagggagcatcaaggttcttacagaggatataaaccggctgacgaataaagggcgcttacatcaaactgtcttaaatatggcggcccgcgggattcacctgagtgttgtaagtaggtgttcacaatgaatattgaaaatccgatggtcttgaacaactggcatgacaaactgactgagccggacacgcaaaaggattactttggggatgaagtaacggctttcgatgattacgtgatagatagtgctgagggtgaaatcatcttgagggaaaaccttgagcggtatctgaaggagcatcttggttttgaatttaaaaatgagcaataaaaaagcccacttggcagagtggactaggtaaggcgttttgataattgattgtattcctattataccaaaacgccccataaaaaacaatggaggttttatacatggctaaagcagttaaagtggcattcagtgagcgtgcggaggatcagcgacgtttaaggcaggtcggcggctcaattgtattctccaaaaacggtaaagcgcagtttagtttcccttcaatggatcactatcgggaatggcagcggcttggaacggaagcatataaaagaaaggtggcagaagcacaatgaatggattatcacaggtggattactcagattacatgccggcgccccagcaggctactggcgtgactatggaagcgatggtaagccgacaggctcaagaagtacaagcggcaatggttatcgcaaagaaattcccacgggacgtatacgcggcttttgaccggattaaaaaagcatgcgagcggaggctattggctgagaatgcggtatatgaatatccgcgcggcggcacaaaggtttccggcccatccatccggctggctgaggccttggcacagaactgggggaacattgattacggaattatggagttggaacaaaaggccggtgaatcatctgtcatggcttacgcttgggatcttgaaacgaatacccggcaaaccaaaattttcactgtgaagcatgaacggaaggcacggggcgccattaccaaacttgatgatccaagggatatttacgaaatggttgccaatcaaggagcccgccgggttcgtgcttgcatacttggagtgattccgggcgacatcgttgatgcggcggtagatatgtgtcaaaaaacattgattagtggacataaggaaccactggaagaccgactcagaagtgccttctccctttttaaaaaagagtttggcatcactaaggaaatgattcaggagtacatcggcagtaatgttgatgccttcactgagcaagatttcctgaaaattggtcgtatttacacggccctgcgtgatgggatggcaaagaaagaggattacttcaatgtgaaggccactagcgcgactaaatcaaaggctgaagaagaattcaaaaagctgaaagagcaagctgacaagcctgctgatagtaaagaaaaggcgggtgatcctgctaatgcggataccggcgctgaacaagaagaattattactctaacgagattgatagacactacatgtcaaattctcaatataaaagctttttgcaatgcgaggctgccacgatggcaaagttgaacggagaatggacgccgcccacatcggaggcgctcctcttcggccaatacgttcatgcctggcttgagggtgaacaggcttttgatgaatttaaaaagaacaccccatcactttttacacaaaagggccagctgtacaagcagtatcagttagctgatctgatgattgaggcgattcaaaatgatgatctctgtatgtttgttcttcaaggagaaaaggaagtcatcgtaactgctgaattgttcggtgttccgtggaaaggaaagctggacgtatacaacccagctggcggccgtttctccgatctgaaaacagcgcggtcattgcgggagaaagtttgggacccggaaataggatattgctcttttgttgaggcatacggatacatcgctcagatggcgctttacgcagagattgaaaaacggatgactggacggagcgaatggcttgagcccctgatcgtaggggtttcaaaagaagatccacctgataaagctgtcatcaatattgatgagggcaggctggaaatagagcttgaagagattgagcagcggatggatcggattttgcaagtgaaacacggcggagagaaaccagagcgatgcgaaaaatgcaagtattgccgggccactaatcaactgaacagcatcatccatttttcggagttggtgagctgatggaaagggagctgatcaggattcctatcccgcattgttatctctggctggtcaaaacggttcagcgcgacttgagaaaggacttgtatacccggtacacgactgactacttaaagacaaatgagccgtctctgagattagtagaagtagatttcaaggctctgacagcactgtgtgaaaggaagtaggtgagcggcatggatatgcaaggtttggggtatgtggtcctgccccggctgccatttaaagattcacgagacgagacaatatacgattatttattcaaacgggcggagtacagggcagatcaagaactaaagctcgggcagacaatcattaagcttgtagatttagccaagcgcttcaactggtcttctgatcagatcaaatactcgttagatcggatggtaaagcaagagtatttgaagctggaccggctgccgcaaaaacgcggtttcattgtgacggtgttgaattatgccgagtacatacagcttggaaattacaacaagaagatagacccggctccaatacctttaggacagcaggaggttgacgaaaaaatgaaaaacgcatttgaactattcgaaaacaaaacagcccgcaccattggcacgatggaggttcagcggctcggatatatggtggatgattacggtgaagagaaagtcatggaggcaatgaaacaggctttcagattcaagggcaacaacgtcaatctgaattacattgaagccatcctctcaaacccattcagccagagacgaaaggagaaacagcagtatggaagctcgcaaaacgcaagatatggacgcggcaatgaaggcaattctaaccaagctccgggatcggtcagcagcatcttcaacgggacaggccgcctcagaagaaaaggctgaatacgagtgctctgactgcaaggataagggcattattgtttaccgtattcaccaagacaccgagcgccaattgagaaaagagcataagacaatggaaagcctggcccctgatcaaatggtcagagaagaggattatcttgcggggaaagtatgcttgccggataaggcccgagaatggaaaaccacattttccaagcaatgcgagtgtgtgaagcggaaaaagatcgcccggcttatgaaggccagcggcatcacggaggaattcgaaaagctcctttttggaaacttcattaaggacgggaagccggatatgatcaaggacgcttatgagtgcgcggtggaatactataaggattttcagagcatcaagggaaaacgttcaaacagtatcgctttgctcgggcagccgggcagcggaaaaacgcacttgttaacggcgatcatgaacaacctgattaagaaaaaatcaatttactgcatgtatttcccgtacgttgagggaatgggcgatctgcgaaatgactttgatcagctggaaacaaagctcgacgctatgcggaaagctgaagttctgttcattgatgacttattcaaaccagtaaagggggagccgcgggcgacggattggcaagtggaacaaattcaatcggttgtgaattatcggtacctgaatcataagcctctgctaatctcttccgagcttgatacgggggaaattttggacatagacgaggcgctgggctcccgcattcatcaaatgtgcagagattacacagtgaccatcaagggcgatcggatgcaattaaaccataggttaggagattgggaatgacggaaaaagcgaacttcacagcaaccggcggcatgtacgtgttcgggcctgctgagcaaacggccggccaggaccttaccccggcgatccgggtgcttgaggaaaaaatcaaacaaatggagctgatgcacagtgcttaaagcggttatactgctgccggccatcatcctcacagcgccgtacaaggaaaagcagattcagcactgggaacaaattgacgggaggtaatgacggttggattccattcagtttatagtttacggcgagcctgttgcacagggaaggccgaggggatctgttataaatggcaaggttaaaatgcgtgatcctttgaaatcaaagaattttaaacaatatgttgcgctggtggcgtcacagtatcggccaaaacaagttattacgggacctgtggcaatggatgtcagagtattcagaccaatgacgaaagaaatttctaattccaagacaaaaagagaaaatgcggaaaagggtctcctgcgtcccgtaacaaagccggacgttgacaactatgtaaagggagttaaagacgccctgaatcatctgatttaccgggatgatagccaggtagtcgatctgaaagttagcaagttttacagtgaagagccccgggtggaagtcattataacggaaatcctgccataacgctttgtggagaaagtttgatgcttgagaactaaatcaattcaggaggttatcgctatgcaagaagaaatcaaccgatacaagcctggtccagttaagaagtggaaaatgacgccggagcaattggcagcttacatcgaaaagcatccgatcatttaccgcgaggaattaaaaccatctgccggagtaacgatgcggctgccgtcgtaaaacgtaaaaaagcaccgaagccgtggccccgatgctctgatatgaactggtacttctatcatagcacagggggcggccagagtgaacaagccgacagaaataaaaaatcatgaaacaactattcagcaaagcatcgagccggggaaagtccgcatcatcgttttagatggcactgaagggactgctcatctaatggacgccccggaacacggtaaaacaatcattcaaacaataaaaggcggcctggctcgttgtgattacgagatcggccataaattcaattagcaggggttttcccctgcgggggaggaacggaaaatgtatcaaaacgaaattgcccgcaagtgtgaacgctgcggaaaaatatattattcagctcaatgggttgtatgcaaaacatgtcttttagaccgggaggcccgggcatgaaagaattcaaaatcaacttgtcaaaaggtgaggttttatataccggctcttacatttgcaccctttcgaaaacggcggccagtacaccggagcaaatatctttagaagcagcagccgaaaagctcgcggaagagttaatcatgcaacaggctatgaatcgggagcaccagcgccagcaggatgtcacggtcattcagtttcggcaggctcaggaagatattaagttgctacaggcggagaacaagcgttatagaaacgcattagaattttacgccaatgaaacgacgtatacaaacgaatttgaagactgtccgcctgctgtcgaactcgacggagggcaaacggccagaaaagcattggagggggctgcggaatgaataacataaaaatccgatacgtattccgacataaggaaacaggcaatgttgaattgaaaacgtactatatcagtcagcttgaagaacgcccggcgcgcaaactgtctcccgtcttttgtgaagagtttggttacgagttgatcagccgcgatttatggacgggcaaaaagcttatggaaaaagaaatatatgcgggagatattatctgttataaatcacacggccgggtgtttaatctagtcgttaaatggtcagaagatgatgccggattttatgcgggtggaatacgttgggattttgttcaaatgtatggtgagttaatcggcaacgtacatcagaatcccgaaatgttaggcggtgctgcaaaatgatgccattacaagtcgaactacaacggaacgtgaaggccacgaaggacgaagcgatgaccgtcgagcaggcggccgagcttttaaaggttcacccggattacatcccgacgctggtcgctcggtctgacgatctgaaaatgatcggtgaccataccattatcgctaaacgggataaaacaaatatctggctggtcggggcatgcgtggggcttttcttcttcgctatctccgtgctgccgaatttgatcgggggttaagggatggcacgctcaccgttaatctggtttggcggcaaaggtcgatacgccgatcacatcataaataaaatgcccgcccataaggtgtacgtcgagcctttcggcggcgcggctcatgtcatagcgaataagccgcaaatgggacatgaagtgtataacgacattgacggccatgtggtgaatttcttgatgcaagtcagaaaggatccaaaggccatgcagcaggcttgcgaatccattccgtacagccgggcgctctatgagaaatggaaaactgaagattacccgcaaaatgattttgaccgggctgtcaggtggttttatatgaatcgctccggcattagtaaggggaacgtggaggaagtgccgcagacaggctggaggcatagcacacaaagcgggcagaaccctgctggcggatacataagcgcctgcgctgccttcgagtctttcgccaaccgtatgaagggcgtcatgatcgaatgtaaggattttcgtaacatcatcgagaaatacgatagcccggatactttgttttatgtggatccgccatatgttgggcgtgaacggttttatgctggcggctttaacgaagaggatcatcgggaactggcccggctgcttaatcaggtcaaagggaaagtggttctttcttattacgatgatcctttgatactcgagatctacccgaactgggagtcagaaaccttttccgcatacaaacaggttgtcggcggatccggaaaaagccgcggggctgaagaattattgctatttaactataaaatcacacaactcagcttatttgatcaggagggaacccaatgccaacagcagagcaattgaaacgaatgaacgacataaacgatttgatcaagcttatcgcaagcattgatcatcgtacattctaccgcaagtcaaaggatcgcatagcgtatttcagatttaagaaaaaactgttcttcgttgatgattacacgggcgctgatgtttacccgtatgaattgggatacggcagttcaaacggcttttcgcatgggggcaacatgtggcaactggtcaacagcttcagaaaattcatcataacagggaaatgcggcgagctgagggattataaagaaatatgggcttacagctatgaaggatgtatgaaaatccgtcagaaggcgaaggagattggtttcattgaaagtgttgattacccctacagctttgatgaatgggcggatagtaaatgatcgaatatcattgcccggactgagattataaaaaacttgatttagaaatccgcgcagatgcccgctgcccgcattgtgggcgctgcataggtggtgaagtggaaaatagaagagcatattagaatgctcttctattagaaaattaatagacaaatacgtgtaactgaccgtatactgatccatttttgaatatagttaaatatgcatttccagctttattgccacggacaagcccattggtatctactgtgaaaacagcgctattatctgaatgataagcgaatcctgatcctaaatatttggcatctaattgtttagaacccccggctctcacttcaaaggtatcgtaataggctttaattggaccaggagatatagttgtttgcgtttcatttttttgaggagttatctccttagcggaagccataccactaatggaaaaagctaatacaggaatcgctagtgcagtaacagcagtctttttgaaattcattttaaacactccttaggttttttattgaacacagtaataattcgagcaaaataatgattatccttgtaaataaatgttaattatttgtgaactaggaaggggaaaataatgaaaaaactattcaaatcaatcattctatcagctgtattacttatgggagccgcggccgttgcgccgtctgcttccgcagcatggtccggctggcaaaatgaatccgggtacagcggccgggtgtttacggatgccgcgacttacacggccggcgcctcaacggtggactggaaagccgagaaaaaaggctcaagcactctttattacacggccggcgtatacaagaagcgtagcggcggcgggcttactgaaacgaatctggtacagcgaggcagcttcaaaacggcaacgcctctgaaatcattcaacgtgaaaacgatccggaataagaccgggaaagggacctatgtcattcagctggactgctactctgattccggcaagtggaactatatcggaacatttgaatcagcaaaatttcaaatcaaataagggggattcgatggcgctgagaatagtttttatgctgatggggttaggtttctggttttatttccagtacgaatacaggccggacatgaaagcaaacatcacgttaataggcgcaatcatcgcattcacggccgcggcgttttttcaagatattgataagtatatagagaagagggaagacaaatgaacggattttctgagattgaacttcaaatgattgttgatgaattaaaaaagggtatgcctttacaactgcagcttgttagccatacgtcaaagctgattgtggcttactatcaggaatacaagaagaatccatatgtggagccggcggacgtggtgcctctagctgttaaatccggaatgaatcaaatgggtcttaattaggaggagagagatgttaatagcctttaaaatagctctcttgctggtcctgatagtctctcttatgggagttataggagaggataaggattcacagctaagaaatcacttaactgcaatttgtatagtagcgatcatcgggaacattgctacatatgtgctgctttaactgaataagtccaagacggaaagcctgcggacactgatcattgcacagaatcactgtgctctgattggtgtccgttttttatttgaacggagggatgacatgaagcagaaaaagaaaaagcccaataaaaacatgcaggagcgctcagatcgtttctggcaacaaatgatgaacacaaacatgcaaacacttaaacgaggcaagggcggcgcatttaagcgcaaataaagggaggaatcagaatgcaagatttaatcattgagtacaaacgagctttaagagaaacaagaaaaatgtatcggctctacaaagatacggctgaagtcaatctgacggctgaacagatcaacgacaaaaagattatcagtagcatgatcagcgatattgaattcactcttgaatggctgcagaacggaagacagccgggcgcacgccgaggtgctgacagaagagacgcatatcaaaggacgattcttgctgaacctcgcttaattgatgcgctgccggaagaatacgcaatcgttcaagaagctgagggagaagtaagtgattgggataaggaaagaatcgctgatgccctatccgtgcttaccgaaagagaaaaagacattttcatgatgcatgctgtacaaaacatgtcattcgaagagatagcgcagttattggggattaaaaaaggaactgtgcagaagaacatcgaacgttcccgcctgaaaatgaaaaatagagcagatcacagcctattctgtttagcgtgaataggctcttttttattggagaaataatgaaaaaagcccactaaattacttgacgtgagtaaataaacgatgtataattaatgtatagaaaggagggaaagaaagtggctgaaatcgcattggtactggggattatcctcacaactctcacagttgttgagaaagtcctcatcatcagggaaaagcttaaagcaaaaaagcccaaaatcaaaaaacgcagacgtccaagaaagcgcagatgattttgagccgagggagaaggtagcgcttctcccttgctccaagtatagcaaatgcggcgactaaagaaaaatacttgaaagccagccactttcaaaaaaatgaaaagtgtacagtccactactgatattgttgttcttctcgccctggcgtatatgctgtttttccgtcaggatgtggcagcgggaccgttgaaaacggctctcgacattagtctgatcattttatttgttgtttcgatcatcgagaaagcattttccctttacttgaaatatcgtgagaaaaaaggatgattcaaaaatgtacaagcctaaagagcgtgacgcaatcaagaaattcctgaatgaagagatactcaatacaagtgaggcgcttgagatattggggttcacccgtcagtatctgaaccagttagtaaagaccggggaattagagccgatgaaagaaatgccccgggacaggctttttctgaaagaggatattttagatttccaaaaacataggcggaaatgagcaccctgttaaaagggtgtttttttgtcttacggttgccacctatttatgaaaagtgctttcgttcgacaaattttgcaaatagttcctttatcacactccttaaccgataataaggtgggaggtgagaatatgatgccaatggtaaaagaatttaatgattttttagagaaacaagggcatagatcatgggaagatattgaaaaagatatgcaagatgagttgtggcggattggtagaaaatacgatgtgacaggacctacagtattccatgagtatatggattggaaggcaagtaaacagaagaaaaaaggataggtttcattaagttacttttgttcatattatattattcagattaattctagaagtggtgagagaaatatggatttgaaaagaatagaaaaatcaattgttcatttaaaatgttacagtgaagataaacaagactttggtactgctctttatgtgaaaaaaggtaataagcaatatcttattactgtgaagcatctaattgtgaatagaaattcaggaaagctccatgaatctataaacaaagcaaacaaatatgctgagaatctcaaaactgtaggggtcgatcaaatatatcgattaggatctggtgagtctggagaggcgcctgtagtttatgaaaataatcactttgagatggacttggctattatatcacttaattttaatgagacaattgaatttaagagaaatttagaatcatccgattatacacctttggattttaaacacatttctgataaaaagttaacgccaggagatgatctatgtttgatagggtatcctgacttttctgatttaggtgtcgtcaatcctatgttaacaaatcagcatcttcctatttattcatttggcaaagtgtctttgttccataaccatttaaactattttatgggcaatatgtttagttatggaggttttagcggcggccccattatttataataataaggtggttggtattaatacagctcaaatagtaaactatataaattgtgagaaagaggagcaaccagttattaagtatccaatgaattatataattaaggctgatattatattttcgcttatgaaagaaatagaatcaaatgaaagccagcacctgcacctttaagggtgctttttttgttccttgtaaaccggttccggtaagtctcaggaaaactataggtggttaacggtctgagtgcggcgtcggtttagagggaatatattttccaaaacaaacacgaatcagaaggggcggcggtgaatgtagatggttgaaaagcacattcaggcgtataaggattacgtcaaaggcgtgaaatacaaggaccttgccgaaaaatacggggtgtcagtgaacaccatcaaatcgtggaagcagcggcatggttgggaaaggaaaaagggtgcacccaccgaaaaaagtgtgcacacaaaaataggcgggcaacccggcaacaaaaacgcattaggaaatagcggcggggcggctccggcaagaaatcaaaatgctgtatcacatgggttcttctcaaagtatctgccggaagaaacgcttgaaatcatggaagagattcaggagcgttcccctgctgatatgatatgggatcagattcagatacaatatgcggctattattcgggcgcagcgcattatgtttgtgcagaataaagatgatacggcaaaagagcttaaaaaggcaaaatacgcttatcatcaagatgaggacgaagatggcaatctaacatatgaaaaaaacattgtagaagaagaacttgaaatacagttcgcttgggatcgtcatgcgactctcttaaacgctcaatctcgggcaatgggggagctccggagcttgatcaagcaatttgaccagctggcgcatgagcaagatgagcggcgtcttaaattggaacagatgcgcttgaatatcgagaaaacgaagaagaccgttaatggcggcgatggaaacacccaagaaaatgatattgctgcaatgttgagaaaaatggtgaatgccgatggaactgaataaaaagcaaaaggaagtttgggacagctttattaaagagcaacccaaaattctaatttgtagcggcgcaaagagggcaggaaaaacattcgtgctccttttgacgttccttgctcacgtcagtaagtatcaaaatatgggtttatccttcatcatcggcggggctactcaggcagccataaaacgaaatgtcttgaacgatatggaactgattctgggtaaagaattgaggctcgacaagtcgaatgccgttgaaatattcggcaaccgtgtatattgctttgatggagccaatgctgattcatggaaaaaagcgcgggggttcacatcagccggcgcattcctaaacgaagcgactgccctgcacgattcattcgtgaaagaagtcatttcccggtgctcgtataaaggcgctgtggtcatgatggatacaaatcccgaaaacccgatgcacaccgtcaaaacggattatatcgacaaagacgggcaaatgctgaaaagcgggcggctgaacatcaggtcatttcatttctcgctgttcgacaacaattttctcgatccggaatatgtggagagcatcgtggcatcaacgccgagcggcatgtttacagatcgggatatacacggttattgggtggcgccagaaggagtcatatacaaggatttcaataaggacatccactatatcagctctgaggaattggaaaacaggcgcgtcaatttcaagaagtattttgcgggcgttgactggggatatgagcacccgggttctattgttgtaatcggacaagatgaccaggggtgtttttatttgctcgaagaatatgccaagcaacatgaggaaattcattactgggtgaaggtagcgaaaggcgtaaaagagcggtacggaaacattaatttctattgtgatacggcacgaccagaacacgttgttcgtttccggcgtgaaaaacttcgggctattaacgctgataaagctgtcgtatccggtatagaagaagtagcgcggctgttcaaacaagaacagctttttgttgttgaagacaaagttgaccggttcaaaaaagaaatctttatgtacgtctggaatcagaagacaggcgaaccggttaaggaatgggacgacgtgctggactcactccggtacgctctgtattcgcataataaaccgaaaagacggagaggggtgagctgatgaatcattttatagacatgattgaacagtccggcataacgcctgaattgattgacaagatcattcaggaacataagccggatcatgacagaatgaaaaagctttatgaacggtacgaggctgaggttcaaggcgttccgatcttatccagagaagccattgaatacgaagattttgaaacaggaaaattaaaacgtattgatcacaaagtaaacaataggcttaacaactcgtttgactctgaaatcattgatacaaaggtgggctatttgttcggccaccctattgcatatgagtttgatgagagcgatacgacaagcactgcaatacctgtaaaacagttgatcgaaaattttaatatggaaaataacattgctgatgaagacagcgagtgggggaaaatggcctctatttgcggttacggcgcccgcctcgcttacgttgatcgttctggaaacgagcgtataaaaaatattgatccatgggaatgcgcctttattactgatggaagtatccatgaacctgcttatgctttgcgatattacacggtgtacggcggaaagatcaaagcagaattctatgatcagaaatatgtctattatttcagtacgaaagacagctcagccttcacttttgataaaaaaacattgcatctttttgatggctgccccttattcggtttagcgaataacaaggaactaaagggagatgctgaaaaggttctttcgttaattgatgcgtatgaccgcacgttgtccgatgcatcgaatgagattgagcaatatcggctggcatacctgattttaaaagggttgggcgctgatgaagagacgcttgaccagctcaaaaagaccggagtccttgaattgcttgacgaaaaagatgacgtaagctatctgacaaaggatataaacgatgccatcatagaaaaccatcttgataggttggaagagaatatccttcgctttgcaaaatcggtcaatttctccgatgaatcttttggtgggaatgtttcaggggttgcgatgaaatataaattgatgtcgcttgaaaacaaatgcatcacgatggagcggaaaatgactgctgctctgcgttatcaatacaaactgatcttttccgcatggggcactaaaaggaaagcggcagcggaagattataaaaaagtttggttcggatttaagcgaaaccttccggcaaatgtactggaagaagcacaaacgacagggcaacttaaaggaatggtaagcgaagaaactcgcctatctctgctgtcgtttgttgatgatgtccagtatgagctgaagaagatggaagaggaagaagaggaatacaggctcaacatgccgccgttaacggatgtggaaacagacgcgggcggtgatgaagatgaaccagaatgatattgataagtacctggacgacatgatcactgaggatgctcagaagattgatgtcgtttttgcgtctcgcttaaaggagatcaacgcacaaattgcccggctgtatgcgaagtacagcaaggacggccagcttactttagccgatgccaacaaatacaatcgtctgaacaaggaaatggagaggatggccgaggaatctcacaaggctttcaaaaccattctgactattgttgaggcattagcagccaagcagtttttagagaattatatgcgttctgcttatctatttgaaatggaatccgtggttaacttgggttttagcatcccgacagccgaagtcattcggcaggccattctaaaccctatagctgaattgactttgtcagctatttacaggcggcatcgagacgattatgtccggcagattcaaatttccgtcgcacagggcctacaagcgggggaggattattccaagatcgcccgccgcattgaaagagcgaccgaatttgcccgcaggaaagcccgtgacgtggcgagaacagaagctcatagggtacaagtctcggcgaggatggaaagcgctgagaaggcctcaaaacggagcaaccttaaaaagatgtggaatgctactcttgatcttaaaacacgagccgggcacaggaaactggacgggaagacaatagaacgcaatgggctgttcaaatcaatttacggcggagtcgggccggctccggggcacatgaataatgcgaaagatgacataaattgccgttgtacgattgcttttaaagtaaacggtgtgctgccggatacgagaagggcgagggaaggcggcagtggggcaggccaaacaattccataccaaacctatgaagagtggtacaaatccattgaggaaaagggaagacgttaaacagcggctttttattttgtcctgagcatgacgttaaaaggcttatttttcatgcactcataacaggcgcgcactgtagagggcgaaggaggaagaagcgtaatgccaactttagaagatgtgaaaaaatttctcgaagaaaataaagaaaacgaagatgtaaaggcgtatctgaatgaactttctgccgtgtctgctgacaaggtgaatgggtttttagatacagaagaaggaaaacgtctcattcagcctcggttggattctcattttacaaaaggtcttgatacgtggaaggcgaacaacctcgatgctctgattgatgcaaaggtaaaagagctttatccagaagaaacagaagagcagaagcggatcaggaagctcgaaaaggagctggaagatcaaaagacagcggcacaacgtgaaaagcttttaaacaaagctgtttcttatgcttctgaaaagcaactgccggcagatgtagtggaattctttatcggtgaggatgaagaatcaacgatgaagaacctcggagcattcgaagagaagtacaatgctgcacttcaaaaggctattgaatccaagtttcaagagaatggccgtgatgtccagtccggtagcaatgaaccgacaaatcaagatttagacatcagctcgcttgcagctgaagcaagtattagaaaataaggagggctatttttaatgccaacatttaatccaaacaatgcattaatgcaagactcagtaaatgggaaggttccaaccgaacaaggaacgctggttttaaaagagtttatgacccaatctgctgtcacaaaactagcaaaatatgaagaaatgagtaagccggagaaggaattcacgtacttggcttctggaccgggagcttactgggttggagaaggcgagagaatccaaacttctaaggctcaatggttaacagcaaaaatgatttcaaagaaattgggtgtcatcatccctgtttctaaagaattcttgcgctactctgtaacagatttcttcacacaaatgcgccctgctatcgctgaagcctttgcgatcaaatttgatcaggctgcgttattcggtgtagattcaccgtttggaaaaggcgtatctgtatttgaaaaaatcaaggaatctggtaacacaattgcgttaaactcacttggcaatctatatgatgagttaaacggggtcatggctcttgttgaagacgctgacaaagatgtaaacggctttacaacaacacgccgattccgtcaaaagctccgcggcactaaggacggtaacggccttccgatcttcaacgatgcgacaggcggcgccacacaacaagcccttggccttccgatcggatatgtggattctaagtcatgggattacgaaaaagcggcattacttgcggctgactggaattacacacgttacggaatccctcaaggcatggaatacaaaatctcagaggatgcaacattgacaacgattgtcgatgcagacggaaacccgatcaacttgtatgagagagatatggttgctctccgtgtaactcagcaagtcggattcatgacactgaccgatgatgcttttgctgctattacaccagcaacggaggcgtaagcttatggggtacacatctaaaaactatagcactaataacggcgacaaattggtgatcggcggcgagctcgaaataaaagagggtgcgaaggtgactgggttatcgggttctgcgcctgctcctaaaactatcacttcggaaatgatcggcgacggagaagtgaaaaacatcaatatcggtgactgttctgtccaaaatcgtaacatcggcactggtagtgtacaaaatgccaacatcggtgccaaggcagttactttagctaaactcggtgacgatgtgaaagccaaactatctgatttagagaatcggataaaagcactggaaggaggcggcgcgtgatatgaaagcatctaacggttccaaaactattgaatgcactgaaaaggcttttgaggtggtttattctcacattggttttaagagagtggatgaggccaaacaatctaaagagctgaatgaacggccgggtacaaaccttcttgatatgactgaagagcaattgaaaaaggtgaataaggatgaaatcgttgcctttcttaaggagaacgaatatgaatttgatcccaaagcgcctaaagaggaactgatcaaaattgttctcggtgaagtgtaggtgattctatggatgttcaaaccgtaaaaaatatgcttggcataaaaacagacagccacgatacctatctggccgaggtcctacctctgttcatagatcaagcgaaagactggtgcaacaactcattcatggtcaatggagatgaaaaattaccagcaggggtaaagctgtatgtcgcgaaagcgatcgagcataacatgactccttccaacctttcaggccgaagtatgggagatgtctcatattcttatgaaacagagctgccaagcagcattacgaagcttcttgctccatacagaaagctgagagtcatatgatctatgaagaattcccgcatatcgttacatttcagcgttgggaagaggtgccggacggcggcgggggctatgttgaaaaattcactgattatctcacaatagaggcctttgtcggcgggattacgtcccgggaatattatcaggctcagcagcttcagaacccggttgatttcaatgtgtatttcccgtatcgcaatgatattgagaagacaatgcggatcatctacgagaacaaggtgctgactctcaaatcagatccgatcgaccagggcggcatgcatgagattatgaatttgaaatgtcaggttacgggggtgctgaagggcaatggctgaggtcagtggtagatgggtcaggcagatgcaaagagccacaagcgagttcagaagccgggtcatagatgatattaagcaactggtcacagacacggccgagctgatttacagccacgctgttctgaatgctccgaccgccgcaatagacgggggaacttgaaaaattcaattgaaatcgactaccaagagggcggcttacgggccgttatttctgttggtgccgattatgccgtatatgtggaatacggaacagggatttacgcagaggaaggcggcggccggcaaacgccgtgggtttattatgacaccaagcttaatagatgggtggtcacgcggggaatgcgggcacagccgttctggaatccagcggtggacgaaggcatgcggtattttgccagtcaaatgtgatagaaaggagctgtcatcatgcgatctgccctgtggccgttgcaggctgctttatttaagaggttatcaacagacgaagagctgaacgggcgcgtcacgggcgtctttgatgcagtcccgaaagatcagcaaaagccttatgtgacaatgggcgatgatgatgtatccccatttaaaaccaagacatccagcggtgaagaaatcaatgtggttttacactgctggtcaggttacaacggaaaaaaagaagcgatggagattttgagcctcatgcttcaagcgttaacaagcaggcccctaacaatagagggcttttctttatgccgttctgagttgcgcagcatgcaggtgatcaccgatattgacgggtacacgcgtcacggcattctcagaatgcgcttcacaataaacaattgagaggatgaacaaaatggcagatttattgaatggtattgatgaggtttactttgttcaaccgatgaatgctacttcaactgaaggtctgtttatcgcattccaaacagaaggcagtcatacgaaagaacaagatacaaaagatgaatcaacaaagtctggccgaattgttgggtacggccctaaatctgagagcatcgaactgacatactatgctgctgtctctgatccgggtcaaacggcgattgaagatgcttatgacaacgaagagacagttcaggtatggaaagtaaacctgaataaaaacaaaaacgataagcatgattctgaatatggacatgcaatcatcgagaacttagaaaaaagtgcaccgcaagatgggtttattgaggtttcaacaacattgcctgttctcggtaagacccgtaaaggtgaacttgatcctctgcctcaagaattaattgacgagatcagatcttctgccggtgccaaagagttcatgcagtttggcgagaatgccaaaaaaacaactacgccctaatgcgccccaaaatctatcgttcacggctacagctgacagcgtgaccgtgaaatgggatgcggtagatggggcaacttcatataaggtatacaggggagcgagcaagcagctggacgcaactgtcactggcacatcccacaccttgacaggaattgcggccgatacgaaactcacggtcaacgtctctgctgtgaacgatgcgggtgagtcctcaatgactgagattgttacgcaaacacaagcggttacgccctaacgttccccgcaatataactgcgaaaagcgccacttcaaatcaggtgagtttttcatgggatgcggtgaaaggggcgacatcttacaatatttacaggttttatgcaaaaatagcgactgtctcaaagaattcgtacacgtcgaatcctaacctgaagccggacactgcctacatttttaatgtgtcggcagtgaactcggctggggaatcggaacgatcggccaattttacgatacgaacagaaaaggaatcatagggtccgggcttcccgggctcttttttaacatacaaaaataatcggaggttttataaatggcttacttaactatcggagataaagaatacaaatcacgctgcgactttgcttttgacagattggcaaacgaaaaatattccactgcggacgaaaagggcaaaggcggcacaatgaatatttacatgagtctgctcaacgaagaggcttcctatctttctgctttttgggattgtgcactcgcttacttgaagaaagaaaagccatcaactgaggctattgaagaagcaatcatgaaaatcattgatgaagacgagacaggcgacgcaattgacaagatgatcaatgaagcattcacaacactggattcagcgggttttttcaaaggcgtaatccgtcagcgttggaagatgatggagaagatgaacaaagggaagaaaccagctccgaacgaaacaccggaaatggaagcgaaacggttggaggacgaagagaacggcaaggaagtcttgaagatgatgaaagaggcatacaaagagagaacgggatcgactacgaccaaataattacgaactccgcacattggctcggggtttatgatgtggatttaatcatgtcatggactcctaacgagtacaagcttctgctcaaaggagccaagttgcgagaaatagatgaattggagcttatggcaagaaacgccatgtttcatcgttacgccatgaatgagaagcgccccaaagaaacgaaaatgtttgatgcgaagaaggccagacgccaattggagcgcaatatcactggcgataacgacaaatggcgcaagtcagatgtaaacgagctcggcaaacgagccaaaggggttcagcggtttaatgatgcaatccgcaaccactttgcaaaattcggacaaggaatggggtgagggaatgatcgaaagactgacagcaatagttgaagcacagacaagaaaatttaatcgcagtatggatcgtgtcaacgatataatgcgccggatggctgatcatcacacagtcgaggttgacgccgagattgccagctttcaggcaagagtacggcaggcggcgcaacaaatagataactttgttcatcgacatcaacgcacgcgagttgatttagatgcggattcagaccctttaactcgggccatcaattgggcgaagcaaagattaagacagattccccaaactgtcaccacgcaattaatggggaatgtgcggccgttatcttccgcattggcacgcgctaaagcagggctatcggcggtggcgaacagaatcacaacgacgatagacggaaatcccactcctttagggcgtgctgtcgctgttgcgcggtcagccatagcatcagtatctcataacgtaactaccacttttaatgcggccacgtcgcctatcatgcgcggggtttcggctgtccgttcagctttggcttcactgccaaacagaattaccacggtcataaacggaaacacggctgcgcttatgcgctctgtggcaacggcacgcgctgctctggcgtccttgccgagaagagtatggattagtatagaagctcgaattgatcggtttgaaacgtcaatgaacaggcttgccaagatcacaaactcagtttcaacggtcatcggtcattcaattgccggggcattaacgtccctacttcctgcaatctcgccagcccttgcaagtattgtcggagcaatcggctcattgggccctatgctcggagtggcagccggcggagtaatggggttaaccagtgcatttgcaacagcgggaacaggcgcggcggcattcggcgcccttgctattacttcgataagcggtgtattcaaagcatccgaagacctttccaagctacaggagaagctggacaatgcaacaagcgcaaaagagcgcgctaaaatcatgaaacagatcaataatctgcaaaaatctcttggaaaagaagagagagaggcattaaagaacctcgaagactttaaagacaactggcgggacatcggtacgatggttcaaaagccgatcttaaaaacattcggtatgtctcttaatacgttcaaactcgcgcttaactcactgattccaatgtttgacgggctggcgaaagagggcgtgggactggcaaaaagcatggacaaggctttcaaggctccggacatgcagagattcatttcctatctgaacaaagaagctccgaaggcgtttgcttcattcggccgatctgccgggaatgtcttgcggacagttttcaatctcatcgtagcattcggaccgaccggaaagagcatgacaaagtctatcgaaggaatgacgcaatcatgggtgaaatggtcagcgaacttaggctcctcaaagaaattccaggctttcgtggagtatacaaaaaccaacggcccaaaattgttgcagattatcagaaacttttcgggcggcctgacaaagctgtttactggattcgctcctatgtctcaagacatgatgacatccctcgtagacctgaccaagcggttcaatgagtgggctggcagcgttacgaaaacaaaagaatttcaatcgttcattgactatattaaaaccaacggccctacagtatggagcacattggggcagatcgcgaaaactatcatcaacttgcttgttggcatggctccactaggcaaaacgattttggagaatgtaaacgggtttttgaaatttactaatgcggcgatggaagcaaacccggcaatcgggaagttcattgcggcgggtatttcattaatcggtgctttaagagctattgttccggcgatagtagcagtcagtgctgtaacaaatgggcttaaagactttatgactgctgctcgatatattcggagtttcagttctgccgcatccggaattagaatggccggattgatcacccaattaaaatcagcgatagttactatagggcaattcattgcgagatataccgttatggcagcaaaagcaacagctaatgctgtgaaaatggcagcatcatggactgcgatgaaaatcggttcttttataacaatgctgaaaaacggcattaagcagatgggacttttcattgccagaataactgttttagcagcaaaatcagcagcccaagcaacacgtatggcagcggcgtggactgcggcaaaaatcagttcatttgtgtcaatgttggcggcaggaattaagcaaatgatcttatttggtaaacgcttggtcattctggcggctcaagcagcggcaaatgcggcgcgcatggcagcatcatgggtcatcgcaatggggcctatcgggtggattacggcggcggttatagccttagttgttctcattattgccaattgggataaggtcaagcagtacacccttcaagtttggggtgtcatatctcagtggctccaatctgtatgggaaggcattaaaacagcggcaacatcaacatggaacgcaataacgtcgttcttctccactgtttggaatggaattgtttcggctgctaaaaccatttggaacgggctatctgctttttttaagtgggaattcaatctgtacaaaaccattttcacaacagtttggaatgctataaaatcgtttgcctcttctgtctggaatgggattaaaaagactgcgacttcaatatggaacggcattaagaacaccgttacatcaatttggtcaggtctcaaatcggcggctgtcacagcctttacgtatatgcgggcccagatcgttaacaggatcattgcgacgagagataaaatgatcagcatctggaatgcaattaagagtaaagtctcgtccatatggaatgctctgaaaagtgctgcagtgactgctttcacctatatgcgcgcacaaattgtgaatcggattattgcaaccagagacaaaatggtcagtttgtggaacgcgataaaaagcaaagtgacatctgtctggaatgctttaaaaagtgcagctgtaacagccttcaactacatgcgggcgcaaatcgtcaatagaattgtagcgacgagagacagagtaataagcctctggaatacagtgaaaagcaaagtgatgtccatttggaacggcattaaaggcgcggcttctacagcatttagttacatgaaagcgcaaatcgtaaaccgtatccaagcaacaaaagaacgtatcgtcagcatttggaatagtgtcatgaaattttttagaggcatcaacctcaagtccattggccgcaacatcatacaaggcttaataaatggtatcagcggcatggcgggtgcattagcgagcaaagttaaatcaatggcaaacgcaattcctaacggcatgaaaaagcttctgggaatccattcaccgtcaagggtaatgcgtgaccaggtcggttatcacgtcggcaccggtatggcggcaggtattgataaatcacagggaaaagtaaaagcggctgcggcaaaagcagcgaaagcggctcagaaggcggctgaggtaaaggtatccaacaaaattaagaacgctgaagtgaagtatgacaccaagaaaatgggcgccgatacgtatatcaaaacattgcagaagattcagaagcaaaacaagctgaccagtgagcaaaaccgaaaaatccagcgcgagatatatcaggcatccaaaagcgcctctgataaacagaagaagctactgaaagagcagcagcgcaaggaagcgaaggcgaaactggcgtataccaagaaagtatcagatcagattaagaaagctgaggcaaaatacgatacaggaaaaatcagcgggaatacctatatcaaaacgcttgagaaaatcaagaagaagaacaagctgaattctgaccagcaaataaaggttcaacgggaaatctatcagactcaaaaagctatgactgataaggccagaaagcagaaggaagccgaaaagaaagcggctgacaaacttaacaagggcattctttctgcaaacaatacttatctctcaaaattcaaaaaagtgaatgataaactgactgccgatattaaggcggccaacgatgcctataaaaaggagctgcaagaccgaactgacgcgatttataacgccatcggtctatttgacgatgtctcaagtcaaaatgtgaacggctccaagctgacttcaaatcttaaaaagcagctggacaagatcaaaacgttcaacactgacattacaaaaatagcaagccgggcaccaaaggcattcacagacgaattgaaagaaatgggtgtcgggtcagctgatcagattaatgcaatagcccgcatgacagattcagagctaaatgagtatgtcagtctgtggaaagaaaagcacaagctggccagtgaccaggctgctcaagaattaaccgggttgaagaacgcgacgaccaagaaaataaatgaattacggtctgccgcaaataaagaactggcacttttgaaaaatgactatctccgcaaaattggggagcttacagtggatgtaaaacagcttggttctctcaagaaaagcggaaaagccatcggttcaaatacaatggccggcattatttctggaatgaagaatatgaagggcgagctggcgaaagaagcaaattccatcgcctcgacaattgaaaaaacgattaagaagaaattgaaaatccattccccatccagattgatgcgggatcaggtcggggtcatggttcctgccggtatcgctgtggggattcagaatggtatcggcactgttcagaaagctatgggcgtcgtcagtgatgccatgactattcagcaggaggatctgaattttgcatatgacacatccatttccagcagcgaactcggcacggttagaaaagaattgagcgcggacatccggaaccttgaattgcctgacaggatgattgttgttgagatggacagcaagaaggtcggtcaaggcgtagaaaaaccggtcacagacgctcagaaaaggtcgaacgcaaggaggacgagatttaattgatcaattatcaggaactgctgcctaatcaatggaaaatcacgtttgacggcattgatatatcacccttcttttatgtgaagtccacgggcggccggggagtgaccggaagagaagtgaatacagccactatcgggaatcgccccggcggtttcctgcggaacacaagaattcctgtaagagtcataaccgttgaggttctttttgctttcagcagtgaagaagagctgaagaaaaagcaggaggaactgacttttattctgcacaccgaagaacctaaaccgttaatttttcacgatgagcctgacagagtctataatgctgtctttgaaagcatttcagaaggcgaagaacagggaggctttcagactgcaacattgacttttatctgtcctgatccaaaaaaatacggcccggcgaaggattttgaatttaattcaggtattcagactatcactaatccgggctatgcggccgtagacccgacaatcgaatgcgtctttgaagagaaagccacttcatatgaagtggctcttcttaatggtgatgggtctgtatcgaaaacgatcaagctgctgtacgatttcatcgctggtgacacacttgtaattgattctgcaaaaagaaaagtcacttgcagcggtaatttaatcatgacagcacttcaaattcaatcagattggtttctgctgccgcctaggacgccagttaaaatcaagttcagtcataagagcagcatcaaatttaatgaggcatatttgtaaggaggtccggtcatggctgacatttatatactttcaccagatgataaattattgacagtgctgtccagccacggacgagaaacctgtacgttctgggatgcgaaatacaaagaagagctcaacaagggctcttctttttcttttgtagccgatgcctcccaccctgatgcgcgcttcctattcgaagagaatcaagtggtattcaaggataaggacggtgtaatgcgtctgtttgtcatcaaggaactggatgatgcagacgaagaaggagaggttaacacccaggttacctgtgaggctgccatgatggagcttgccgaaacatttgtaaaagatttccgcccaactaacaaaactgctcagtttgtactggacaacgtcctttctcggtcaagatgggtggcggaagtaacggcggagcttggagtgaattcgactaccttctataaaaaaacagcgttggattgtattgctgacgtgatcaatatatggggcggagagcttcaggacactatagaatttgatggaaataaggtcgtcaaacgaatcataaaaatacttccccgtcgcggtaaagacagcgggaagcgctttgagagtgataaggatacaacgaatatccggcggactgttatcagttacccggtgacagccctttggggttacggggcatccatagcatctacggatgaggaaggagaggaaacgggcggctattctcgttttattgatttctctgaagtagaatggaaaaaatcaaaaggcgacccggtcgataagcctttaggccaggaatgggttggcgatccggatttattagaacgattggggcgccttaaagatggaaagttgatccatagggaaggccaatacaatgatgaagacataacggagccggaagagcttttaaaggccacatataatcatttgataacgactgcatgtaagacagaaatcaattatgagttgtctgtgcagctgcttgagagcgtgccgggacacgaacacgaacatgtggaattgggagatacaacgatcgcaattgatcgaaacttcgctatcccaatcgagacatcgcagcgcattatttcaatggaatacgatattaccgaccctgaaaatacttgcgttgttgagatcggccaatttttatcagcattacaaaaagacggccggattgatcaaattgaaagcgtgatagaaaaaaaccgcggtacttgggaaagcaaaccggatgccggggaggttacggatggaagtttccctgacaaagccccgccagttccgtcgaatgtagtgatcaaggcaatgtttcagaatgtggccctgacatgggattatgatccgtccagttatattgcagcctatgaggtatatgcttcacaagtaaatggattcactccattaaaagagaatcgtattttcagaggcaaaacaggcggatatgagcattttacgggagtaaatgaagtttggtattatcgcttgcgctcaatcaacacacgaggcacagcgagcgaattcacggatcagttttccgcgaccactcagcgcattttgactgatgacattgttttcggagcgatcacaaaggaaaaactggcccagctggccgttgatgctgataaactttcaagaaactttgatgatgctaatatcttacctggctctcttttaaaatctaaatggttctatgattatacggacaccagccacagtgttgaggaaaaagaatttaatgaaatgactgtttctcagatcatcaatggaacaactagaatagctttcggaatatgcgggaacaggtcatcgcctgttaatattcaaagaatggcattgatcaaagatcaacaatatacactgtcatttgaaataaaacggaataataccaccgacataagttatattcatttgaaaaaaggcagcactttcatacagattagcagcgatgaacagaaagatatttctgcttttccgtctgaccaatttataagggttaatatcaaatttactgctccggaaaccggctctgattacacaattggaatcggcggatataatcgaaacggaaacactgagccctgtagctttgttattcgtaaggtacaggtgcgcaaaggcgatgtcatttctgattatggttatagcccgtttgatactcagctggttgatggtgttattgatggcgaccacctccaaaaggcggtaatagaaacagctcatataaaaaatgcagccataacaagtgcgaaagtagctgaagcggctatcgggacagcggctattcaaaatgcggctatcgcaaaggcgcatctaaaagaagcaataattgattcggtacacatcattgacggttcaataacaaacgccaagatcaaagacctttcagcggacaaaataaatgtcgggacgttaaaaggtatcacgattgagggggtgaccataaaaggggcccgtttcgaggcgctgacacaatcagaagatgccgaatactatatcgaaggcgataagatttaccagtacaccagagactctcattatgtttacaacaaattgattgttagttctgggaaaataacgcaggaacaaggaaagttttttgatcctggtgattcctataatgaaatctacagaacagtttcaattggtgatggcaaaatagagctccgtggcgcaggcaagcaaaccgcatatgaaacggttccaactatttcaatgtattcagaaataggagatgttggacaagttataagccattttaatatgaaaatggaaagacaggcagctgttgaagaagacgcttttcttcttactgctactaccaatcctaaaaatataggagagccgttcacatataaccgttatcaggccctttttgaaggatcagctactatttatcgctttaaaccgaataatttagatattgatgtccccggggtcattcgactgaaatcaggccaaaaaacgattgttgatgcatcagatttaacgctgccattgggaaccaaagttgtagcagggaatgcaaaaaattgcgaattcaaattgatgggtggcaatgtttctacagaattagaagacgagcatggaggcctacaatacggtttgatggtttactgctttacttgggacattaaactgccgcctgacggaggggcaactgcgtacgcgcgctacaatcgcattccttttgttgatagttttgattatgcgcctgagaacgtttttgcggcggtaggtacagcgattggcgcatattctaatgcggttacggtaggattagaaaatataagcgccagttctgttgatattggagtgagagggaccgggactactgccggagttgcgggaaaaacaataaaggttcaaattgttattttttacgaatcacaataagggagtaatttttatggttgaaaaaagggattttaacatgagtctttattatgcggacggcatcgaaatagaagaaaccggcgcgggaattgaaataactgccggctctataaaaaaaggagacaagacatatcccatggaggctgtttcgttcgatctgcagccggacgatacaacaaaagtagcgtatcaattatatgtccttcatgatataaaggctgatgaaataagttatttgctcacaaaaacttatgtagagcctgacggttattatcaagggtacagtgggagcaaaaagcttattatgattccagttcaaattgtcgttgatccacaaggcaaccgagaagggcttataacaatctatgttcaaaataaggaggatggcaaagatgaagcttgagcccgtggtattaaatattgaagcaaaagatagagagaaggaaaagactacagaggaaaagttgcaggaacaagttcttgaccttcagcgggtttgcaatctcttaatgaatcaataaaaggaaacggggggagcccattggagaaccgaagtgctcttttcgggttttttgaggattgctggaaaaacggaactgttttgaccgttgaaatgagaaaagccgttgagaaaggccgcatcacacaagcggaatatgatgaaattacagaaagcgaacgcggtaatgcgtatcccgatcaagagtaaggagtgaaaggcatgcaagaaatgacaaaagagcaacttcaggaccagttacaaatagcagcatataaagctgcttccctacagcaggaattgaatctgaagaacaatgagctggccgaatataaagcgctatacacgtttacagataataaacgcgaggaactcgaaaagcaattaaatgcggcagtagcggcgaaagaaaataatagtgaaccagcacctgtaactgaataggtgtttttattttgcctcgaaggaggtgatcaaaatggagggaatacatgtgtggatgaattttgaaagcttacagatcgcaagaacatatcttttcggggaggtgaagtaccttgacttgcttctaatcctcagcatcttggatgtcatcaccggcattatcaaagcgtggaaaatgaagcagctccggagccgcagcgcgtggtttgggtatgtgcggaagatgctcagttttatggtggtcatcgtcgccaacattattgatacgataacaaatttgaacggcgtcctgacctttggaaccgttcttttttatatcgcaaatgagggcctgtccatcacggagaatttggcgcagatcggcgttaaaattccggccgtcatcactgaccggcttcacgtaattgaaagcgacaacgatcagacaaaagaaaaagatgatcaggcggctggttaatccggctgcttttttgaatccaaaaacagaataggagagattttatgtcagcatacagaaaccaatatattgatattaataaatggacgcggccgggaatcaaaaacaacggcgtgaagaaacttgtggtgcattacacggccaaccccggcgcgcctgctgccaatcattatagatattttggccaaacgctccccgcacagaacagaaatctatctgagaaaaaacagacgtttgcatctgcacatatctttgtcgatcgtacagaggctatttgtatcattccgttgaatgaggttgcctatcatgcgaatgacattcagcaattcgtcaacgggcagccttaccggggtgtcgcggcgctgaaaccgaatgcaaatttcttatctatcggcgtggagctttgcattgaaaagaacggcactttccatccggatacgattgcccgtgcaggacaagtttgtgccgagctgtgcaaaatgtacaaacttgatccaaccaatgatattgttcgacattatgacattacacataaaatttgcccggcgccgtgggtaagcaactctcaagggtttgccgattttaagagccgtgttgaaaagcgaatggatggtgtggttgtaacggcgcctgtatcaaatccggatgttacccatacagacacaggaagattcatcaaaaacacggtggtttcaagcgatggccttgttttacgtacacaacggagcgcctcttcttccatggtgcttaacctgccgaatggcacggttgtaaaatatcagcttggatcaactgtcaacggatggggatatgttgaatacaccaattctaaaggccagacattccacggatatgtgaatgtctcatatatcaaaagcgataacgagctgaaaagcggcggccaaaagaaggtaaaagcctcaaagcctaaaaccactcaaaaatcaaaattcagtctgcctgcgggtgtttttaaagtgacaagcccattgacccgaggggaggccgtaaaacagattcaaaccgcgctggcggctcttcattattaccccgataagagcgcaaagaacttcggaattgacggctcatatggcgcgaaaacagcaaatgcagtcaaacggttccagtctatgtacgggctgcctgctgatggcatttatgggccgaaaacaaaagcgaaacttgaaaaattattgaagtgatatagcctcgtccaatggacgaggctttttttgttgtaaatgggagaaatacataacttttaagctagtatgaagtcaaaaaatatacttttattggtgaatatatggtaaattcttttatgtgtgttatttctaatgaaatgagggaatttaattggacgaattaaaagaaaaaagaacagggacggttgcccagccattaccacaaccagcagttgacgaacagcttaaatcagcattccaaatcatgacatctgtggtgaacgattcgaatcgaacgtttaattctgaaagaaaacttgataatgtagctatttttgttgattatgataacgtttactggtctctaatgaataattatagccatgatccagattatcaatctgaagataaaaatttattttcaaggttatgggaacgatacggtcaagacaatgtacgttcatttagagtgtatgcggattttaacaaattaagaagtaatatgacaagtcttcaaaaaaagcgtgttcaaataaggcatgtttattcaaatggaaaagatggggatcatcgtaaaaatgcatcagatattgaactttgtattgatgctattgaaaatacatacaaggatccttcgattagttgttatgtttttgtaacagctgatagtgacatgattcctattatgagtagattaatgtacaagggaaaaagagttgagctttattattcagctaaaaacgctcctaaacatattgaatttaagaattatgctcatcatgctgaagatttggcgagtttacttggtattgaagaaaagcagtatgaccgagataaacttatgaatcaaattcttgttgagataaagaaatggcacgatagctttggtacacaaggagatctgttcttaggcttgagttggttcaaaagatatctaataaatacattatcgaccccagcagagattattagtgagattttagaggaacttaaacaaaagagctttattgttgaagagacaaaagtgttaagcaaaggtaaattaaagggcagttccaaaaatcaaatcttatgttctgaattagggttagctaaaataactgaatcagaagatcaagcacaagttgtaaaataattgcttttttgcttgacaggaaatatatattggatgtattatgaatacacattagaaaacacatacgctattattactattcgctacatattcgctaaagaaagcagggagataccctgctttcttttttatttaaaattccacctgtttttatgcttatcccacttcaaaatgcgctgcctcatcaaattcttcacagcagcacggatcgtctgctcatctttcccggttttccttttcaattgttccatggagggatttttcccgaagcgggtcatattaaaaataatccgatacactttacgctcaaaatcggtcattgtgtttcatctccttggagacgattataaagaacgtgtgttcgcgatgcaaacaaacctgttattttttaaaaaataacacaaaaataacgaaagttgcgtcagggtctgaaacaatgcggtttttgtttcttttccattcatgatcacactaaaaaaataacaccgattgaaagggtgcgaaagcgagcgaaaaccgtggtaattatgggcggcatgatgtaatctcccttgggtataccaagggattgactgttgagttcacttgaaatgctcatagcgttctatcagaaaggtcttatcagttactcaactagataagaccttttttgtttataaaaaagagaaggtatgagatcgtttgtctaagattgacctcacactttcctaactacaatgtgatttcctcatttccttcaagcaccattctcagctgctccacctcaccccgaatcccaatcccaggctcccacgaatcaatcagacgaatggccttctgattcgattccatcgctttcgtattttctcctttacgatacaacagctgtgccattccgtaatagtaatagatcaactcaacttgattggcgttgtgtttgtcatagagcatttgttcaaaggctttttccgctttttcgagttgatcacacttgacgtaagccatgcccaggttgaaataggcttctatcgttttttcgccgccgtatgcggcgctggttgtgtttgccgcttcgtataatgtgatggcttcttcgtagtgagagcgggcgaaactcaggtcgccgcggaccagaagaaccctgtgccggataatgggggagacgggctgatctttgatgccgtccagcattgctgccgctttgtccggttctccggtttttaacagcagcctcgattgcagggcgattccccatactttcaagtcgtcgtgatccggcgcgcctgattgttcgagtatcttcaggccggcttctatttgcctgagggcttcgtccgcatcattaacttccatcagcgcccagcctgccgtgtcgatcctgaagtaggcttcccgcgtgtgttcgcctgattgacgggcggcatcggcggcttttaatccgtattcgattcgcaggggcaggttgattctgcttagaaaatggctgatgcggatgatgagtttgatcaggatgtcatgttgtccggtttcactcgaccattcgatgacctttaggatgttcggccattcctttttcatttgctctaaattccgtcccagcagatagctccaatagacagaattgggctgttcccgctttatatgggtttccgcataatcgatataataatgcgcccagcggctgcgggctcctttttcaaattcgtgattttcggataagtgctgttctccgtaagcgacaacggtttgatgggctgcgtattgaattcttccttcgcttcgttccggctgtattaaagcatatgaccgcatttgctcaatcgcgtaatgaaaccgccggacgtctaatccggccgcttgagccaagcttttttcatcagggggcttagcgaaaaagcaaagcgtctgccatagtttccgtgtgtcttcatgacatctgtcccatgtgcggccaaagagaacctcaaacaattccaataatgagtagcccgcttgtttaagttcttgaatgagctggggagcggggatgtcgtcgtctgacatgtatgcaatgctcagtgccatggccttcgggttgccggcggctgccgagacgaattcattcttaaggtcaggcgatagccgccgcagctgctccagcttttcccgtttttgcgggaggttgcatgtttgcagacagcggtgcacttcttgatggaaaaattcaagggcatccgtttgttcaaggccgctcagctggatggccgccagttccccgaggccgtcccggtatgtctgttttacgttttcccgtgccgtaaggagaacttttacgccttccggaagaccgatgataaattcgtgaatgtcacgttccgctgtatcgatgctgtcaacgatcagcagcacgggtttttcgtttgaatgagcggctaatgcattacggacgacgaaccgtttttcgttgatggatttgtctatttgttctgcgcgtccgagctgataggcgatcgtgtttaaaaaatcgctgaagctcaatcctttccagtcagcgctgatccaaatgatgctgttgaatgcaggccaatctggtgaaccgccggcacaaaggtaggctgcttcaagagcgattgtggtttttcccatgccggcccagcctgtgattaaacagaccggtgacggagacagcatccattgccggatcgcctctatatcaaagccgcgtccgataaagttcccggtccggcgtgacggtaagttatgcgtgacgggctgttctgtaagcgcattcgtttcatggccgggtctgtcatgaaacagccgctttactgctttttcaacatcttcatcactcggcgctccgaatgatccgtctttccggtgtatttttgctttttttagacaagacgccgtccaaacgggcaatgcgggtttgatgacgggaatggtggtggtttccagaaggccggtcagccattcagtatccatgtcagtcttttcgataatgatccagatcatgccgaacagctttccgtcgtcaattcgtccgggaatgtagtttgcgcccatctgtccgatccagcttttgatcgtgttagaggaaacgcctaatcggagtgcgatttgatcgatataagactgtcctgttttttcgttctttttccttctgactttataatcaggatgaagtttcagcgatttgacggcaggtgccagcagttctgcaaattgtgtccggttttctagttcagccattagcctgcacctcctattagtactattttatcaattcagtgttttttgtatatgaaaaaataaaaagtacagtgcggctgtccttttatacagcaggaaaggctgttgaacgtatggaaaagcagataaaataggggcagtaacagagaaaacaaaaatgtatgcacttacatttcaaagcagagaaaggattttgccaaatgactcacacagtgcctcaaaacatgaaagcggcggttatgcacagcacgagagaaatcaaaatcgaaacattgcccgtgcctgacatcaatcatgatgaagtgttgattaaggtgatggctgtcggaatttgcggatctgatctgcattactatacaaatggcagaatcggcaattatgtagtggaaaaaccatttatcctcggtcatgaatgcgcgggagaaattgccgccgtcggatcgtctgtcgatcaatttaaaataggagaccgggtcgccgtcgaacccggtgtcacatgcgggcgctgtgaagcgtgcaaagaagggcgttataatctttgcccggatgtacagtttttggcgacaccgccggttgacggcgcgtttgtccaatatatcaaaatgcgccaggactttgttttttcgattccggattcactttcctatgaagatgcggctttgatcgaaccgttttctgtcggcattcatgcggccgcgagaacgaagcttcagcccggttccacggttgcgatcatgggcatgggtcctgtggggctgatggccgttgcggcagcgaaagcatacggggcaggcacaatcattgtgaccgacttggagccgctgcggttagatgccgcgaaaaaaatgggcgcgacgcatgtcatcaatgtccgggaacaggatgccggtgaagaaatcaaaacgatcacgaatggcagaggcgttgatgctgcctgggaaacagcggggaatccggcagcattgcaatccgcactggcttccgtgcgccggggcggaaaactggcgattgtcggtttgccttctcagaacgagattccgctcaatgtgccgtttattgcagataacgagattgatatatacggaatcttccgttatgcgaatacgtatccgaagggaattgaatttctcgcttccggcatagtggacacgaagcatcttgtaacggaccaatatccgctggagaagacgcaagaggcgatggaacgcgcctttcaatacaaaaatgaatgcctaaaagtgatggtgtatccaaatcgctgagtgaacggggaggatctttgcattctccctcttgcttatcaaaaatgaaaacggattcttggggtgggaaatgatgattgaaacagaaaaagcatcggcagtaaagacgaaacatcgcggcctgtcctggatggaacggatcggctacggattcggcgatatgtcgtacaatattatctttcagtttgtaaacgcatacttattattctactatacagatgtcggcggcattaagcctgcggtcatcgcagctttgtttcttatcgtaagggtgctggacgctatttttgacccgattatgggcgtgattctagacaagacgaatacaagatggggaaaggcaaggccgtatcttttgtgggtggcgtttccttttgcgttatttacgttcttatgctttacgactcctcatttcggcgagacagggaacatggtttatgcgtacatcacttatattctgcttgggatgtccttcagcatgcagacgattccggtcaacagcttaacgggtcggatgacgaattctgtggaggaacggacggttctgacgacgacccggatgattttggtttatatcggaattctgttatcgatttcctgtgcgacaccgcttgcggacgccatcggcgggaaagatcaggcgttcggattccagatgacggcgcttatctatgcggcggtgagcatcgcattgaatctgttcagcttctttaccgtgcgggaacggattcagcctgaaaaaagaaaaaaacaaggaatgaaaaagacgttgtctgttttgttccgaaacaagcctttgctcattttggtttcttcatttttagcttttgcgatcgggtttaacattaagctcagcacgatggtgtactattttacgtataacgtcagccataaggaatttgtgtttttaggaaccgtgctgtttttcggcgcagcgctgatcagcaatctgtttattcctttcttttctaagaagcggggccggaagcaggtcatgatcatcacggcggcgttatcgctgatttcttatgcgggccttcagtttacatcgtattcctcgattccccttattttcttttggcttttcgtttcgggatttttcacgacgcctttaaatacgcttgcttggggaatggttgccgattgtgtcgattatgcggaatggaaaaccggagtccgggctgatggcgtggtgatttcgagcatgagtttcatcaataagctcggagttgcgttagcggggtcattttcggccgtttatctcggaatcgccggatatgccgcgaataccgatcagaccgcctcgtcattgaatgcgattaaaaatatgaatgcgctcattccgggattgttcattctgctgtctattattcttatttctttttatcctttaactgaaaaaaaatatcagcagatgatgtctgatctggagcaaagggctgccagataagtatacgtaaaatttaaaatattctatgtaaacggttgtatttatgacagaaagcactatactgaaactataatcgagaattgataaatgagtgtgataatgtgggaaggcaatctgttatttgtattggagaattgttaattgatttcttttgtaccgatgtggatgttgatttgacggaagggcgcaatttcttaaaaagtgccggcggcgcaccggcgaatgtgtcggcagccattgctaagctgggcggagacgcggctttcagcgggaaaacaggcaaagatccgttcgggtactttctgaagcagacattggacgccgtacatgtcgatacgtctatgctcgtcatggatgagaaagcgcctacaacgcttgcgtttgtttcattaaaacaaaacggggagcgcgactttgtgtttaacagaggagcggacgctttgtttacgcttgatgatattgatctggaaaaggtaaacgatgcgaaaatccttcatttcggatcagcgacggcattgttatctgatccgttttgctcggcctatttacggctgatgtcgattgcgaaagacaatggacagtttatttccttcgatcctaactaccgtgaggatttatggaaaggaagagtttcagagtttataaacaccgcaaaaaaagccattgccgtaagtgattttgtgaaagtcagtgacgaagagcttgagatcatcagcggtgcgaaggatcataaagaaggcgttgcggttcttcatgagcttggggccggtattgtggcggtgacactagggaaaagcgggacccttctttcaaatgggaaggatattgacatcattccgagcattccggtgacatcaatagactcaacgggagcgggcgatgcgtttgtcggcgcggcgctgtatcagctggcgcgcacggatgaggttcagacggcagccgaagattttgcgaagctgcgtgatattgtctcatttgccaataaagcgggggcgctcgtgtgcaccaaaatcggtgcgattgatgctttgccgagcttaaaagaggttgaagtatcactgtaaagtatggaggatgtttcttgaaagtcatcggacttcgggaagcatcctctttatttaggtctgaaacccttttcgatatacggtatactttagaaaggcatccagtaaattgaaccgctgtgaagtacatacaataatgtttttatcagttctgagtaaaaccaagtttctgctgctgccgtcatgtacagtgtgacggcctgtgatattgaaccgcggaggaatttttttatgaaacatgtttttcttattgtgcaatgcgcgttttctgttttttgttttctttgtctcgccgctgtcaattggtatcaggggagtgagcttgtttctgactcgtttgattggaatgatacggctaaattctcaaagcttttgaatgggacggatacgattacaagtccggaacagatttcgcagctggatttctttgtgtatgcggcgaagcattatccgttagtgagcgggttgatgatcgggctgtttgtttattctttgttctcactgtatctgctcgtgaagaatttccgccggcacaaatgggctgaatgagactattttcatataaaaatacataaattcaagagaaaatgaaacctttttcgaaaaaaacagtatatataactgtgaacttgttactatttaattttgggaggaaaatgaaaaatgagtattttaggaagatttaaagacattatgtcaagcaatatcaatgcgctgctggataaagctgaaaaccctgaaaaaatggttgatcaatatttacggaatctgaacagtgatttaggaaaagtgaaagcggagacggcttctgtcatggctgaggaacagcgggcgaaaagagcattaacagaatgccaggctgatgccgaaaagatggaaagttacgcgatgaaagcgttgcaggccggcaatgaagccgatgcgcggacatttttggaaaggaaaacggctgttgaatcaagactgactgagctgcaaacggcttatcagctcgcttcttccaacgcgtctcaaatgcgcaaaatgcatgacaagcttgtcgctgatatcggagagcttgagtcgcgaagaaatgccatcaaagcgaagtggtctgtggcaaaaacgcaggagagaatgaacaaattggggtcctctgtgtcaaatgcgggccaatcgctgacagctttcggcagaatggaagacaaggtcaaccgggcgcttgatcacgccaatgcgatggctgagctcaacgcgtctccgaaagacgatattgacgagctgacggctaaatatgacagcaatcaaagcagtgtcgacgatgagttggcggcgcttaagcagaaaatgcttttcagtaaagatcaatagacagcgggctgcagctttgtccgatataaagagaaagtgagagaaacagaatgatcatttcttataaatgcccgaactgcggcgatgatatggtctttgacagttcatccggcatgctgacatgtcacagctgcgggcggcaggatcagattgaaagcctgccaaaagagtatataacaacgagattttccgaaaatgaggcgaacgagtaccgctgtgagaactgcggcgcggtattaatgactgaggcggaaacgacggccacgacgtgcgggttttgcggaggagccgccgttctcgccgaccgattatcgggaaatctcgcgccttcgatggtgattccttttacgatcagtaaagaagaagccatgagcgcttttaaaaagtggtgccgaaacggccgtctgacaccgaaaggatttatgactgccgatcgggtgaagagcataaccggcatgtacgtgccgttttggatgtttgacttaaacagcaaggttcaggtcaatgccgtttgtacgagagtgcatcactatgaagatggagaataccgggtgacggagaccgagtattacaacgcgtaccgcgatatcaatcttgattatctcaaaattccggtcgacgcttcagaaaaaatgaatgatgaattaatggacaaattggagccttactcatacagtgagctgaaggagtttaatacggcctatttagcgggatatatagcggaaaagtacaattataccgatgacgatctctttccgcgggcgaaggataaaatcagccattatattgattcttatatcagatccaccttctccgggtatacgacggctgacattacggatgagcagattcagaccgataaaatcagcagcttttacgtactgcttccggtctggatggtcagctacgactatgagcgggctgagcacatttttgcgatgaacgggcagacgggcaaggttgtcggcaaaccgccgatcagtgccggaaaagtggccgcgtggttcggcggcataaccgccggtgcgtttttagcattaagactcgtctcacttatgataggaggcggtttttgatgaaagtatcgataaaaaaagcgtgtctcttctgcttcgtcctttttctgatgctgtctttttctttacatacatcggcgtctgccgcggaacagaagcaatatgtttatgacaatgctcatttattaacgaaggatgaaacgaagaaacttgaggaattggccgggaagctgggagaaaagcgccataccgattttatcattcttaccgcaaacggaacgggcggtaaggagatcgaacagtatgccggtgatttttatgacagtcattttagcggaagcacggcgatattgactattgatatgaaggatcgggaagtatttctctccggatataaaaaggcggagacgtatttgaacagcagccggctgaatacgatcagaaatacgatctcgtcagatatttccgcaggccattatgaaaaggcgtttcagacttacatcaagatggcttataaagatatggggaaaagcccggacgacaggtctgacaatctgctgctcacatggtggtttcagctgattatcgctgcagcagcggccggaatcgccgtcaccgtgatggtgtacaattccggcggcaaggtcaccgtcaccggcagcacgtatatggatcacgatacgtctgaagtgctgagccagcacgacacatatatccgaaccgacattacaagagaaaaaaagccagataaagataatgacaatgacggcggagtcacgaggggcggcacgagttacagcggaagcaagggaagtttttaaattatatgtaaaggatttgagcatacatgggttttttcagaaatcagttagcaaatgtggtggaatgggaagaattcagagacgacatggttttctataaatggaacaaccgtgaaattaaaaaaggcagccgtctgatcatccggccgggacaggatgccatctttttatacaacgggaagattgaagggattttccgtgatgacggcgattatgatatcgaatcagaaatcattccgtttctatcgacactaaaagggtttaagtttggctttaacagcggcatgcgggcggaagtgctgtttgtgaatacgaaggagttcaccgtgaagtggggcacaaaaaacgccatcaacattccggcggcaggtatgccgggcggtatgccgatccgcgcaaacggcacatttaacttcaaggtcattgactacatcggattgattgataagattgcgggtgtcagagacagctatttagtagaggacattaaaatccggattacgtctattctcgatcagcttttgatgaaatggatcaccagagaaggaaaagacatgttcaatctgcagtcgaattcatttgaaatcggaaaagggattcaagaagatcttgatatgcagctgatcggagacggcatgtcgattacgggcttcaatattatgagctttaactatccgcaggaagttcaggatatgattacgaaaaacgcttcttacggcatggtgggcgatgtgaaccgctatcagcagatttccatgacggacggcatgtcatccggcaaaatgagcggaagcggcgccgcctcagacatggcgggcatgatgatgggaatgaatgtggcaaatcaaatgatgaaccaaatgaatcaaaatcagcagaaccagccgcagcaaaatcaaagtcagcagaatcaggggaccgaacaggcaaacggctcggaaggagcggctaagccgaaattctgtccgaactgcggaacgaaaacggaaggcgcgaatttttgcccgaattgcggacagaaacttgcctgatgatatacgaaaaagaggcctttttggggcctctttttttgtcatgatttcattgtttgaacgatgagggatgtcagcgcttttgatccctcaggtatgagatggacgccgtccggtgtgaagtattcagggtgctgcaatgcttttgcgtgccaatcgacaagcgtcacatttttgcgtgactcggcctgccggcgcaatgattcgtttactttgctttcccactgccgcggtacacgcgtgttgacaagatagatatcggcttttgaaaaggagctgatcagtgattcaatttggctgtttgtgaaatagccattcgtccctaactcgatgatgaccgctttgttcggctgattaaatgacgcatattccgaagtgagctggagtgcttgagagacttgtcttcctacctttccgtcgatggtgacatgagggagggactgccgcaggtatgacgcaatgtccagcatcaccgagtcaccgatggccagcacgtcttgctgaggctgtgtttgttttggatcagccgttttttgagatgaccgttcctttttctcgtcgtttttcttcgtatctgatttgtctgctggttctttcttgtttttgtctgacgcggtatccgttttttcgccgccgtgttttttcttgctgtcttcttcttttgcaggctgatcgtgatcggccgttttgtgcgaagaggcggcggtttcttgctgatcattctgcgcgtacgtccattgcggctgttttttctcttcggctatccctgacagcccgcccgcaaatacgagaatggcggcaagaatgaggccgagcgacattctgctgatgacagaggacgtcttccattccagaaagcggttcagaaacacgcggcgtaaaaatggccggaagcccgcagtgcggatcggctgttcaatgaaatggtaagatagctcggcaagaatgaaagtggcgccgattctgacggcgcagtgccaataaaccggatttccgatttcctgcacgggtgtgctcagtacgaaaaccgggtaatgccaaaggtagattccgtatgatctcgttccgatccagcgaagcggcttccatgaaaggacatgtcccaaaaagctgctcggatggcataaacatgcgacaagaaccgctgcggtgatgctgatcaaaagcatgccgcccttgtacaggaagggttcatattcatccgtgtaaaagacgcaaagcagcagcgcggcaaaagcggcaagctccgtcccgtgaagcaggtgtttcatgctgctcggcagccgtttggaagataatcgtttcatcggccacactaaagctaaagcgcagccgatcagcaattcaaatgaccgggtatccgtcccgtaataaacgcggctcggatctccgccgggcacatacatcatactcattacgactgccgaacataacgcgaggaacatgaccgcggccgcaagccgggcccgtgttttacatatgtacattcccgcaagcagcaggaagggccatatgatataaaactgttcttcaatcgccagcgaccaaaggttttttaatggcgaaggggagccgaagctgtcgaaataagaaagttgatgaaagataaaccaccaattgcttatgtaaaaaagtgaggagaccgcatctccgcgtacggtatgcaggagctcgctgttaaacaatacgacccaaatgaccgtcatgataatcatcagataagccgccggcagaagccgtctgatccggcgcacccaaaaatcacgcaaatcaagggtgatggcattgccttggacaggcaatataatagatgtaattaaataccccgataaaacaaaaaagatatcaacaccaatgaaaccgccgtcggcccagttaaaattcagatgatatgcgataactgcgaggacggcaaaggcgcgaagtccatccagtccgggaatatagcggtgatgcagtgacttgtctgacatggtattcctccaataatgtgtgcggaaattctcgctgttttgcggatagctatagctgatttctgtacagtcttccatttgttccgttaattagacgcattcggaaggggattttgtttcagaaaaaatgtatgaaatgctgtgattttcttaaacttttcagtcccagtccggcgtctgttatatgaaaagggtcccttatgcatcttggctgttgcgggacgaaagaaaaaatccatgatctgcggatatcatggatttttttctttctttatctgatgtagcggtctccgacaagcagcttggagatgacggaggtcggtattgtaaactctgtaacgcccatatatccgggtgccgcttcgtattcatcaaatgaaataacaagtttgtgcttatctgtaatataaaaattctggtcggcgcggatggctttaaaaggctccgtcatatcatcttcttcgacccagtatattttattcggatcttctttcatctgttttttcatttgttctttaatattttcgctgatgactttaatataacggtcatctttaaataaactctttaacgtaagcacggcctcattctttttatcaatcgtgatgtaacggctttgcgtataagatgaagcttgcgttttttcgatatcacggcggattgagatcagatccgctgtgtcagtaacggtttcataatcgctgtaaatactgaggtggccttttttgctttttgaggtcgccttcataaattcctgatacagctctttgctttctttcatataatgccggttgatgctgtcttcgagtttatgatcggaaagtccggacagagcgggcgttttcacatcaatgcttgattggttcttttcttccttcatctccgtgaatgtgatggcttggacgactttgccgatgacggggattttagacatggcttgtgcggcatccgggttgatattgacaacggcggtaaataagacggccgcagcgactgccgcggatgtcggccacatcacgattcgttttttcttcggtttttgctgaagggctttttcgacaatgctgtccagttccttaggaatgggcacacttttatactcttctcttaattgttctaatctcttttccattaagaaagatcctccttcgtcagctgaatgcgcatgagcttcagccccctgtaaaggcgtgttttgacggtgttgatgttttcccccgtgatgtccgcgatttcttctaatttcaggtcttcaaagaaacgcagaatgataatggttttatattgatgcggcaggtcatcaagcgcttcgtgaaggtctgtgtccttgtagtgatcttcctttcctcggcttaaaaactcgatcgtttcatcatccatcactttcagttttttctgtttgcggagaaaatcaatggccgtgcgcactaaaattttataaaaccagcttttgatcacatcggggtttttgacggattcgaccgatgtcagcgctttttgaattgattcctgaacaatatctaacgcgtcatccttgttttttacgtaactgtacgcaagccggtaaaagtcttccttgcgctcagttatgcacgtcacaagcgacgctttggctgtttcgttcttcattgcttcaaagggctcctttttaaaaaatacgtatcataggctgctgcctaaggatagacgggacagggtgaaaaatagtttgcgcagaggggatcatttttaaaaggaaaaggaaggaaagacgatgagatgaaaaaaagagccggaacggctctttttcggatgtgtctgatattcagctgaacggtttagttcggtttgactaagattttcacttggtttttctctttgattaaagcgccgaagccttcttcaatcagatcgtcgagcacgatttttttcgtgacgagcttatctgctgagaagtagccctctttcatcagtgcaagaacggaagggaagatgtcacggtatccgataatcccttttacggtccgttctttgatgacgatatcgttcggatgaatttccgctcctttttcccagatgctgacgataaccgtttcaccggcaatgtttgttgactggatcgcctggcggagaacgacaggaacgcccgttacttcataagaaacatcaacgccgccgtttgtgcgtttagcgatttcttcaacgacatcgtccgtttttgacggatcaatgatgatagcgccgagttctttcgctttttcctgacgttccggtgaaagttcaaccgcgtaaatatctgtggcgccggccgctttcagggcttcaatcacaagcagcccgatcggtccgcagccaaaaactgccgccttgtcgcccgcttttaatttgctttggcggacggcgtaaagcgctaccgctgacggctcaacaagcgcgccctgttcgtaagaaagctcttcaggaagcttaaacagcaattcttcgtcaacggatacatattcagaaaatccgccgccgcctccggctaagcctaagaatcccatttgttcatcaaggttataggctccctgatgtccgtgtgtggcaaaaatcggttccacgacgacacggtcgccgacgctgtaatttttgacgccttcgcccacttccacgacttctcctgagaattcgtgacccatcgtgacgggcgccatttcgtttgttaacggatgaggttcgccgaccggaataaagatcgggcctcccaaatattcatgaaggtcgcttccgcaaatcccgcaccatttgactttaattttgactttacccggttctgctttaggttcatcaatgttttcgattcgaatgtctttttgattgtgccatcttgccgctttcattgattatcactcctagtctgattgaaacgagtataggtacatgatcaatatgaaccacggttaaaaggaataaagtgcttcctaaagcctgatttctcaaaatatatcatattatgcaactatcaataggccttataaaaagtccatattgaatgcagaaatactctatgaatattataacgctaatgaattaaattttgtagtataatttaccatggaattatatagaacaggtaattgtgccgtcgttatgtgcatgtctcatcacgttgtaatgaacatgtaaagtgattgaaatattataatcgtcttcttggtgtataattttgcctagaataaagaatcaggaggacgaaagcttgaagaagttattcttagccttattgattttagcaggaagcacgctgggagcgatcagtttctcttctgatgcaagtgctaaaaaagtgaacggaaatattacatggtataatggagtcggtaaaaaaggatcttccggtaaaaaactgggacactgggattgcgcgacaaaattaggatttgacgttccgagaaacggaacgaaaatcagagcttatgcgaaagcaaaaccaaaaaaggttatcacagtatataaaaatgatgtaggccgtctgccgaatgccgtattggatgtcagcccgaaagcgttcaaagcgctcggatatccgttaagcaaaggaagagtatccggacactacagctattaaaatagaccatcttaaaaagcaaggactctgattcttgctttttctgattgacggagagattgataatgaagaagaaacgatggatctggatgttgcttgccgccgttttggcggcggcggtcatcgcgtccgttttactgatcaaaggaaaaagcgacggcggcggaaaagccgttgtctccggcggccatgacaagctgcttgtttccattacagacaaagatctgatgacgaaatattacgaggacggccgcgtgctgtacgaggaaaagctttcggcatatccggcgtttgcgctggatgacgcccatcaggtgctctattttgtcgggaataatgacgaaaatgagatgcgtctgtataagcttgatctgaagacgaaaaagaagacggtgctttataaaggaacggcaagcgctgacagtctgtttttatcaaaggatctgacgcacatttatttccgtctcggaaaagcggatgaagatattttccgtctcgcatcttttgatttgaaaacgaaacgttatgaaaatctgtatcctgccgccgatgagaaagacgacagtgtaagcagcttcttttataaccgcagccaaaacgattttgcgcttctgcattattccgtcaaagaggattatcaaaaaacggatgaggcaaatgagaaggggattgaccctgaaccgacgaatatccggtttgcagcaggagctggcgaacaccttcaggacctgacaaaccttgaacagtttatcagcggcgtggcggtgtcaccggacggaaagaaccttgtctttacatcttatacacaaaaagggacggaacaaaaagcgtccatccgtctgatgaatgtcaaaacgaaaaaagataaaacgattatctcaaacgggaaggacttcgctccgctgattgatgcccagcctcagttttctaaagacggcagcatcatttatttcatggcggaagcaaaaggcgctaagcgtctgaaggatgaaacggggcggaatgcgaaggtccggaccatttatgcttatcatttggatacgaaaaaatgcgaaaaagtctgggaaaatgaccacggcattatcaatagtttttccgtcatccaatcatgaaaaaaacactcagcgcccgctgggtgttttttcatgaacaaagctggctgcggctgaggcgagccatttgaaaaaacggagaatcggaacggcaaaatgaagcgtttcgatgaatgactgtgcggcaaggttcattttccgccgttttgccatttccttcagatctttctgctgccgatcgtttttcatgttcattgctcctttgcatcataaaaggacatgataacgcaaaggcctctcatgagacatggaggccttctctatgttgagactcgtaaaagggaggtctaacttgatgccgtttgattattgttttggagatttaccaacgaacggacgccgtcgatcattttactgccgcaaagggggcaagtcggggtatcactgccggcaaaattctttctgctccagccgatacagtcctcttttgtgcattcccacgtactgacatcttctttaggcagcggttcctgattacgtttgttgtagtaagacataaagtcacttcttcccttatgaattttcgtgcactccttcattgtctcatacttttccctaatctcctaattcctttttctatccagatttccaatgagggtgcatcgtcttcctgttattacagtatatgcaaaaaagcgccttcttattttttctttttggataaataaaaaaagccccttctggagaaagggggggatgtttgtttactgcttatccgtgacgtccatcggtctcatcatgtcgtaatcttcgtgctctaaaatatgacagtgccatacgtagcgtccgctgtaaggagcgaaagtcgccgcgattctgatgacttcccccgagtgcgcctgcacggtgtctttccagcctttttcacttggaggaggcgggacggcggggcctgtatacacaatgtcgccgaatttgttataacgctctaagtcaaagggacgccggtcaaggatttggaaggaaacaaggtgcaggtgtatcggatgggttccccccatcggattgataatcgaccagatttccgttgcgccgagcttcggcgcttctgtcacaggatcatgccatcgcttgttattcagcgtcaaaacgggccggccgtatttgtcttgcgtatttgtgagtttcagtgtcctgatgttgtgtattctttttgatgttacattaggcattgttgaaagatatttaggcttccggcttgtgtcttctcccttcagcggttttgtgacgcggaattgcatcacattggcgtctgtatccggatcgacgtcgcccccgcagccggtgccgttcgttaaaatgatatgttctccgtcaaaggcggagaaatcgatgagcacatcataccgctcggccggggctaagctgatagattgtgttttgacagagcggggaagcagtccgccgtcagaaccgatttggataaacttcccgccgttattgagcgagagagaaaatgttctcgtattggaggcattaaggatgcggaaacgatatgtccgcggttcaacttccatatacggccacgctttaccattgacgagaatggtatttccgcaaaaaaacgggacgatggaagggtcgggcagcgtttcggaaggattagcaggtccgcttggataagacaaggaaccgtcgtcatttaacgtgcggtccaaaatcataagcggtacgtcgtactctccggagggaagcttcagctgcttttcttttcgctcgcggatgatatacatcccggcaagcccggcgtacacattgagcctcgtaatcgccatggcgtgatcgtgataccataacagagccccgcgctgtttgtttggataatggtatacctctttctcaaaataaggacccgtttccttaaaatcctttgtgaaccaggcttctgggtagccgtcgctgtccggcggcgttgctcctccgtgtaaatggacgacggttttgacatcgggttcctgatggccgctttctgaatggtgaatggtatgatccacgggcagaaaatgcttatccggcaggtcattcatccatttaatatagacgttttcatctttgttcacgtcgatcgtcgggccgggaaacaaaccgttatacccccaaagccgggtcggcgggagatcgcggtgcagcttgtgaaagcattccttcatggtgacttcgtaatacgtgctgccgtctgatttcttctgcggctggagtgtttcgataatcggcagttcatctgcaaatttttctagtgccatttttcatcctgtccttatcatttattgaaatcctgtactacagttaatgctgcctggaacaggttggttaaaaaaacacccgcccttttttgagggggggtgtttgcggttattgcgcaacccggctttcggaagcgctctctttcggtttttgttttttgcggaatacatatgaggcaagtaccagcagagtaataaatcctgtcagcagaaattcagaccgcattgaactgataaacagcatagataacaagatggcgcaaatggcgatgatcgtcaggtaggttaagtacggatagaaccacattttgattttaagagattcagggtttgtccgttcgattttctttctcattctcagatgtgagacggcgatgacgagatagacgagcagtgcgatcgcccctgatgaattgaccaggaacaaaaatacggagtctggagaaaagtagttcataacaacggcaatgtaggaaaaaaaggtgccggcgataatggcttgaaccggtacgcctcttttactcagtttcataaaacgccgcggcgcttcatttcgctctgccagtgaatacagcatccgtgacgtcgtataaagcccggagttcaggcaggacagaacggctgtcaggacgatgaaattcatgatttgagcggctgcgggaaccccgatatggctcaaaacggcaacgaaggggctttccaaaatattggctgaatcccatggcagcagtgtgaccacaaccgcaatggagccgacgtaaaaaataatgatccgccaaacgactgagcgggtcgcctttgtgacggattcgaccggatttgacgtttctcccgctgcgattgcgacgatttcagatcccatgaaagaaaaaatgacaacgacgatgccgagcagaacggaacttggacctttagggaaaaatccgccgctgcccgccaaattttccagcccgaccggcttgctgccgggaacgattccgaaaatgaacgcaaatcccgcgattaagaagacaacgatcgtcgctaccttcactaaggaaagccagtattcaaattcgccgaacgatttaactgaataaatattcgtcagtgttaacagcacggtcagaagcagactcgtcagccataacggaatgcccgggaaccagtactgtatgattccggcgcctgcaatggcttcaatggcaatgacgatgacccagaaaaaccaatacagccatccgatcgtaaaaccggcccaaggaccgatggcgtcatgcgcgtactgtgaaaacgaaccgcttgtcgggttgacggaggacatttcccccagcattctcataataaaaatcactaataatcctgctaaagcgtaggagacaatcgctccgggtccggtggaatgaatgactgatccgcttccgacaaataatccggcgccgatcacgccggcaattgaaatcatggtcatatgccgggtttttaatcccttagataaagagttaggctgattcattctttgcctccttttggtttgtttatgctgaatattcagacaagtattattctatcataaatgccacagacagttgaaaatgatgtaagaaaatatgacatttttttcgcattcgtacagcagaaggcgccgggatgaaagaggaacatgccattgaccattcacacgttcatatggagcctctccagctgaaataaagcttcctttctaaagggagcttttttcctttttcggactggaaacaattcgctggaaacgtttttttatactgtttatattttgtggtaaagttaggttacgataattgaaatttgagagatgactaggaggagaagaatggcttataaagaagagctgcatccgctgctggagaaagccgttgagcatattgaaaacatcatcataggaaaacgggatatcgccatactcagtctggccgccattctcgcaaaagggcatgtgctgctggaagacgtgccgggagtcggaaaaacgatgatggtccgggctttggccaagctgatcggagctgactttaagaggattcagttcacgccggatcttctgccgtcagatgtgacgggtgtctctatttataatacgaaaacaatggaatttgaataccgcccgggaccgatcatggggaatatcgtgctggctgatgaaattaacagaacctctccgaaaactcagtcttccctgcttgaggcgatggaggaagggaatgtcacgattgacggaaagacaatgcggctggctgagccgtttttcgtcatggccacacaaaacccggttgaatatgaaggaacgtatccgcttcccgaagcccagcttgaccggtttttatttaagctgcgcatgggctacccgactgccgaggaggagcttcgggttctgtctttgcaggaagggcgcaatccgcttgaaacaatcgagcccgtcatttctaaagaacagttcatcaccctccagcaaaaactggagcaggtgcgggtggatgatggagttaaagcgtatatcgtcggcattactcagcatacccgccggcatccgtccgtacatctgggcgtcagcccgcgcggttcaatttcaataatgaaagccgcgcaggcgtacgcgctgcttcatgaccgcgattacgtcattcctgatgacgtccagtatttggctccgtatacgctgccgcacagaatgatcttgaccgccgaggcgaaatttaacgatgtgacgccggaagcggttatagaagacatcatgcaaacggaaaaagttcccgttcaaaggatgtcggtccgctaatgagaaagaagatgcattggcttctatatggctggaagctgcttatgttggccgtactgacggcggctgtcttttcttatgccatgtttcagggcggatttgtgagctggtttttattttatgcgtttttgccgtttaccgtttacgccgggctggtcgctgtgtacccgttgcgggcgtttcaggtgacgcgtgacgtgtcctccgcccagttaacctcaggcgacaggctgtctgccaccatcaggctgacgaggcgcctgccgtttccgctgacatatatggtcattgaagatgtgatgccggaaacgcttggtgagaggcgcagtgcgaaacagcttgtgtttccgtggtttcaaaggaagatgacgttacaatatgagctgccgcaggtgccgcgcggagagcatcatttacatacgatcagagttcggacgggagatgttctcgggcttttggacaagacggcgtcgttttccgtaacggatacggttctggttttcccggcgtacgggcctgttcactataagccgcaggctgcatccggagaagagggtgcgggtgccggcgctccgtttcaggtacaccgcacagcaatggctgcgagcgtcagaaattatcagccgggcgaccggttttccgcacttgactggaaaacatcggcgcgtcgaaatgagctgatgacgaaggaatttgacccgttgcagagtatgaatatgattctccttttggactgcaggccgtccccttcgtttgaagccgcggtgtcagcttcggcatccctgctttacacggcgcttgtgaagggctctcccgcaggatttatttcattggggagcgaccggactgtatttcccgtccgggagggagagcggcatttcagacagatgctgcgttacctggcatcagcttcagagtcggaagaagccgatgcaggcgggcgtttagggaaagaactgggtaaagcttccattgccgtcgtgacgggcagtcttacagaagaccttctcaaacaggctgagcccggccgtgctgacatgacggtgtttttggcgaaagaaacgaatgccgcgctttcggagaaagaacggaaactcgctctcatcttcgctcagaaaaatattaaggtgcaaatgatcagggacaaacgggtgtcccatgttgtttagaaagagaggtggcgcgccatgccgcatgacgagaaccagggaagcaggctgagtctgctgctgttttattttctcgcttttttattgttatgggaatggctcaggccgctgcacaattttacggatacaaaacataccggttttttcatcgtttttatcggtttggcatttctgctgtcattcttccggatgaggtggtacgtgaccgtgccgtcctgcattctgtttacgttgatcagtattcacatcctgttttataaaggttctatttttcagccggaatggctcgtttcttttttgcgggacgtgatgcaaaatgcccgccacatcggaaccggaagatggaatgatatgaatccgtcattccgcacgttgctgttttttgtgcttttatggctgctcgtgtatttgctgcattactgggtgatctatcagcggaaaatattattcttttttatcatgacggtggcgtatatcaccgtgcttgatacgtttactccttatgatgccgcgtacgccgtcatccggatcgtctttatcggctttttgatgatggggcttttgtatatggagcgcatccggcttacggaacacatagcgtttaaaaaaagattgatactcaaatggtttctgccgctgatgctgtttatctgcgcttccgtagtgttcggtctggcggctccgaaatcagacccgaactggccggatcccgtgccgtttctaaaaaaaatcacaaaccacaaagaagtgcccgccgccgaaagtaaaatcggctacggcaatcatgatgaaacattgggcggtccttttcaggaggatgatacgccggtttttacatggaagggaaaagaacgggcgtacttccgggtggaaacgaaagatacatacacggggaaaggctgggtggagaccgatcagggcatgtcctataaactgaacggcggcaatgtggaagatatatggtttgaccggagtgtgcagacgagacggtatacggcacaggtgtccattgatgagaattatctctataatcacgtcatgtatccgatcggcgtctccaatattaaaccgaagcactcgattcagcttgaaatgaacggaaacaccgagcaaattacgccggtcagtgaacaagtgggcaacatccgcaatatgggacggtacacggtgacttttcaggcgcccgtctttaagctgaatgatctcagaaaagtgaaagtgaaacgataccgtgagcagaatcaattcaatgaccggtatttacaggtccccgacagccttccgggaagagtgcgacagcttgcggacagattgacgcgggatcatcataatatgttcgataaagcgaaggcgatcgaggattatctcggatcttccgcattttcgtataatacacaggatgtcgcggttccggagcacaatcaggattatgtcgatcaatttctgtttgaaacgaaaagaggatattgtgataacttttcatcggcaatggccgtgctgctccgctctgcgggaattcccgcccgctgggtgaagggctatacatccggtgaatataaaggggcaggcgaccataacggccacatttatgaagtcacaaacaacaacgcccattcgtgggtagaagtgtattttcccgatcagggctgggtgacgtttgagccgacaaaaggcttcaccaatccgacggagtttacgtcagagcaaaatcataccgcggcaaaagacagcggaggctcagcggggaattcggattcaccgtctgacaagcagcgtcaggaaacaaagccggaaaaagaagaaacaccgaaaaagcgggatcacagcgcggcaccgcagcctgtgatccgcaacaaaaccgcggcacacctgtggccgtatgcagccatcgtcatcgtaatttcagccgcggcggcactcgcctggctgttccgggtgcgctggattccgcacgttacagcagccggattgaagcggcgaacggatgaagacgtctttttcgacgcatatgccgcgctgctccgccagctgaaacgaaaagggttcagcaggggagacggagaaacgctccgcgattttgccgcaagggttgatgaggcgcaccatacaaacgacatgtccgagctgacgctgcgctatgagcgtgctttataccgcagcgataatgccgcaaagctttggaatgaatcgggacagttgtgggaaaatataattaaaagaagatagtcttgaccgcatatcgtcctgttgttagaatatatgaatgttaaatgggagcccgggagcgttaaaaagccgggcttccggacaagtcttgccgacagagggctgaacgtgtgtcctccgttttttctgtgtcaaaaacttagaggagattaggtgacaaccatgacgaagttagtgaatgaaatgattcttgttcttgatttcggcagtcagtataaccagctgattacccgccggatccgtgaatttggcgtatatagcgagctgcatccccatacgttgacagctgaggaaatcaaagaaatgaatccaaaaggaattatcctttcaggcggaccgaacagtgtatatgatgaaggatctttccgctgtgatgaaaaaatctttgaactcgatattcctgtattgggcatctgctacggcatgcagctgatgactcattacctcggagggaaagtcgaggcggcaagccagcgcgaatacggaaaagcgaacattcagattcaaggaactccagacttgttcaaggatcttccggaagaacaagttgtctggatgagccacggcgacttagtcgtacaagtgccggaaggatttacggtagacgcgacgagccatcactgcccgaactcggcgatgagcaaaaaagacaaaaaatggtacggtgtgcagttccatccggaagtccgtcattcagaatacggaaatgaccttctgaaaaactttgtcttcgggccttgtgaatgtaaaggcgaatggtcaatggaaaactttatcgaaatcgaaatgcaaaaaatccgcgaaacagtcggagacaagcaggttctttgcgcgctaagcggcggtgttgattcctctgttgtggctgctttaattcataaagcgatcggcgaccagctgacttgtattttcgtcgatcacggcctgcttcgtaaaggcgaagctgaaggcgtcatgaaaacgttcagcgaaggctttaatatgaatgtcattaaagttgatgcgaaagacagattcttaaacaagctgaaaggtgtttctgatcctgagcaaaaacgcaaaatcatcggcaacgaattcatttacgtatttgatgatgaagcggacaagctgaaaggcatcgattaccttgcgcaaggaacgctttacacggatattatcgagagcggtactgcaacggcgcaaacgatcaaatcgcatcacaatgtcggcggacttcctgaagatatgcagtttgaactgatcgagccgctgaacacccttttcaaagacgaagtgcgcgcgcttggcacagagctcggccttccggatgatatcgtatggcgtcagccgttcccgggccctggacttggcatccgcgtactcggtgaagtaacggaagaaaaacttgaaatcgttcgtgaatcagacgcgattctgcgtgaagaagtggcgaaccacggccttgagcgcgacatctggcagtacttcacggttcttcctgacatccgcagcgtcggcgtcatgggagatgcgagaacgtatgattacacaatcggtatccgtgccgtaacatcaattgacggcatgacatctgactgggcgcgtatcccttgggatgtgcttgaagtgatttcaacacggatcgtcaacgaagtgaaacacatcaaccgcgtcgtgtatgacattacgagcaagccgcctgcaacgattgagtgggaataaatgaagataaaaaacgtctcttttaaaaaagaggcgttttttttcatctttttgaaaccgttttgccccgattcatatctaacagcataggaggtggataaggtgaaggaagaacgattgatcaaaaaggcgaaaaaaggtgatgccgcagcctttgaaaaactgatcacaacccatcaggagactttatataaaacagcttatctttatttgcatcacaaggaagatacactggacgctgttcaggaaacggcttacaaggcttttcttcatatcgcacagctgaaggagccgaaatattttaaaacgtggctgatccggattctgcttcatacgatttttgcgatgaggaaaaagcacggagacgtcattccgtttgagccgcagcacgatacgcgcgcggagaataagaatattgaagaatacatagatcttcggaatgctctggaaacgcttgacgaacatatacagctgaccattcagctttattattttcaagatttctcgattggtatgatcgctgaacagaccggtatggcggaaggcactgtaaaaacgcatctctacagggcgagaaaagcattgaagcaggaactggaaaaggaggataaacacatatggaaaagcatcaaatgaagcaattgtatcaggacattgacgtgccgaaagctgagttgaaaaacgtgatacacagcgctgctgtccgtgccggaaaagaaggcgccgtcagacggagatggggacgaaaagtgataaacggcctcgcggttgctgctgctctgtttattctgtatctgtcctcaggcttgttcatgccctccgttaacaccgctatgggaaacattcctgttgccggacaaatttacagtctgtttcaggataaggcaggttctgcgctgtttaaaagcaatttggtgacaaaactgaacgaaaaagcggaatcacgcggaatcacggtgacagtgaaaagtgtgtattacgacagcggacagctcgtttataactttatcgttgataatttgaaatcagatgaggagagcatctcttttcaagtcgattataaagatccacggaatatgttagcagaggattatgacagcagtgatatgaaaaaaatgaaagacgggcggtacgcggggcagcttcgcctgttcacggacggctcaaagctgaaagacggtgataagcttccgcttgtcattacacaaatcaaggatatccccggaaactggcgctttacactccctattaaaaaacaaaagtccgtttctcttgaaggaacgaaagctgtgaatgtaaatcacggattataccgctttttcgatatccgggcggaaaacggaacgatgggatcggctctcctgtattctatcgacttctatgatgcagccaaaaatgatgccatctcgattgacgaagcaacggatgatgctggaaaccattatgaaatgacgatgtcgaatattgaacttggcggcaggaagaatcttcccggcggcgggaaaagaatacgcggccaaactcaattcagcaaaccgatagacccgaaagcgaaaacacttttcataacgggtgatataaaaacagaatcagagccgggagaaatcgtgcctctgaaaacaaaactgcccgtcagttataaaacgaaacatcatcatgtcggcattaccatcaaaaagatcaaacagcaagacagacgggtgatcgtcgattatcaattcacaggaattaattacagcaaagcggataaagatcagctgatgaatgtcggtgaatcaatcggtctcggcaatacgaaaaaaatgaaaacttggccatcgcttaatgagtatgaaaaaggctattatctgaaagggaataaggcgaaagtcacgaatcttaaaaagggtgaaatggaatccgtttttgaattagatgattcatccgataaagactattcattgcgcgatttctcattcgattcatatgctttgtacgtcaatcaaacggttatgaacttgctggcggatgacaaggggatcacattcgcggtgccggttcggcctgcgaacggaaaatgatgccgggaaggcggcccttgccgtcttccatttttggtcaattaacgaataaaccaattttttttaactggattgttcgtttttttattgagttttcaaaattgaattgatacaatagactcagaaatcaaatatgcagatatcgtataatggcggggatatggcccgcaagtttctaccaagctaccgtaaatggcttgactacggatcaatctcaatcgtttgatataaataatccattcttatttattcagactgaacgtatgtagtcaagcgtcccaaatgtatttggggcgttttttatttggcggataacgggcagaataaatgggagagaatgaaggaggcaattggcttgaagcaattttttcagtttgatgagctggggacaagctatcgtaatgaaatcatcggcggtttaacgacctttttgtcaatggcgtacattctgttcgtcaatccgctgacattgtctttaaacggtgtgaaaggatttcccgaagcattaaaaattgatcagggcgcggtgttcaccgctacagccttggcatctgcggccggctgtattttaatggggcttattgcaaagtatccgatcgcgattgcgccgggtatgggattaaatgcgttttttgccttctctgtcgtactcggcatggggatttcatggcaggctgcgctttccggcgtcttgatttccggaattatcttcgtggcgctttcactgacgggattgcgggaaaaaatcattaatgcgattccgcctgagctgaaattggcggtcggcgcgggtatcggtttgtttatcacatttgtcggtttgcagggttcgggcattattgaagcgaactcatcgactttggtgtctatcggcaatattcacagcggccctgtgctgctgacggttttcggtgttattgtgacggtcattctgatggtgcttcgcgtaaacggcggcgtgtttatcggaatgcttttgacggcggttgccggtatgatctgcgggctgattccggttccgacacacattgtcggcagcgtgccgagtcttgcgccgactttcggacaggcgtggatgcaccttccggatatcttctccgtacaaatgctgattgtcattttaactttcctgttcgtcggatttttcgatacggccggtacgctggtagctgtagcgacacaggccgggctgatgaaggaaaacaaacttccgcgtgcgggaagagcgcttttggcggattcaacatcaatcgttatcggagccgtgctcggtacgtctacaacgacttcttatgttgaatccagctcaggcgttgcggcgggggcgcgctccggcttcgcggctgttgtgacgggcattctctttttgctggcgatgtttttctcgccgcttctgtcagttgtcaccacgaatgtgacggctccggctttaattatcgtcggcgcgctgatggtggcgccgctcggtaagatcgcctgggataaattcgaggtggctgttccggcatttttaacgatgattatgatgccgctgacgtacagtattgcgacggggattgcgatcggttttattttctacccgattacaatgatctgcaaaggaaaaggaaaaagcgttcacccgattatgtacgggctgttcgtcatctttatcctgtatttcatcttcttgaaataacggaaaaaccggctggggaaagccggttttttgtttttgtcctattccgtaaaaccaatacataatataaaacgtcatgtgggtgtccgggtgaagaaaaccgcttgactgtttaaggccgcttcggtaccttatataagtgttttattttcttgctaaacaaattccgccgtatttttttgataggagttgctgacatgacggaagaaagaaaagaaacgttggaagaagaaaaacagcatcagggaactgatgaagaaccgctgtcgagaatgtccagaaatgcgggacgttatcaaaagcaaaagaaaaaagaaaaggaacggcgcccggctccggcttttacggaaaaactcgcttctgcatgggccgcggtcaaacgttattgccgtttcgcgctgcgcattttgacatcaccggtgaaggtcgttggggaagacggcttttcccgctttaaatatgctcttatttcaatgcttgtattcagtatctttttctcaatcggaaattggtttcagctgagggcaagccagcaaaggcctctcggatacggggagcggcatcatacgttttttgacggctttaccgtcgttctcgtgtatacgctcgtcttttttgccgctgcggccggcgcggtctggcttgtatcacgttatatgatgaagcagaaaattacgatgcgggatgcggccgcgggggtcggatcgcttttggttccggctgtcgcctgctctatcgtgtggatgattttcgcgatattgaatctgccggtcatcaccgtggtgtttacggcgctgaccttgtttctggccgcctcggcgatggtgcagtttgtgcagattctatacaaatcggctgaaaagcctgcggctgacgtgatgtactgtatttccgcggcggtcatcatcatgctcgtttttacggctgtgacatggccgctcatttccgagtactttactgcttcgctgattcctttataagtcgaaatttgtctttcacaatgtttacaaatttttctaatgaagcgtgttgttttgaggacccggccgagatatgatgagagcaacagcaattcgaaagcggcactactctttatgattcggaaagggatgatgaagatggccccgttgttgcgagaagccattaatcggaaaaaacagcacctgaggacaaaactgatccgctcagggttttatcaagaccatgttcaggaactgtccgggtacacgctgagtgaacttgagaaggaatatgaagccgtcaaacgattgaaaaaagccgagcttcactgataagagcttgagagtctgccttgcggggcgggcttttttttcttttgaaaatgatgaaaagagggtaaactatccttaattgaaagattggcttttcaaagtcagaggaggggaatcagtgatgcagacaattttatccaacagtataggtatggttctcattattctcatcattaacattatatatgtctctttctttacgatcaggatgattctgacattaaagggacagcgctatttcgccgcaggcatcagtacaattgaaatccttgtgtatgtgaccggcctgagtcttgtgctcgacaatctgaatcaaattcaaaacgtcattgcctatgcgctcggctacggcctcggcgtcatagtgggaatgaaaattgaagaaaaactggcgctcggctacataacagtcaacgtcattacgaaggagctcgatctggacctgccgaaacagctccgggaaaaaggatacggtgttacaagctgggttgcgggcggacttgaaggagaccggaccgccatgcagattctgacgccgcgcaaatatgagcttcagctgtatgatacgattaaaacgcttgatgaaaaagcgtttatcatcgcctttgagccgaaaacgatccacggcggattctgggtgaaagcagtgaagaagaggagaattaaggaatgacaaagccaaaaaagaaacggtttgaagtaacggaacatgaaacgattgacaccattctcactttaatgaaggaagagggttatatgcccgtccggcggatggaagagccgatctttacagaaaagaaagaaaatggatcaattcaagtcgttccttgcgggaaaaaaatcgtatttgaagggaaattgatctaaacacgaacattaaaagaaagaatttttatatcgttcgataatgtcgttgacattatccaagtccgttgttaagataaacatgaaatcaaaacacgacctcatataatcttgggaatatggcccataagtttctacccggctgccgtaaacggccggactatgcaggaaagtgataaacagctgacatggatatcgcagaagcgaacgactgacgatacgcgcgccatgcccggtttgtattgcttcctcatagttgcaatataagccgggcttttttttctgaaaaacaaagcatgagaaggtgggaacagaatgcagccgctagcaggaatcatcatgggaagcacctccgattgggagacaatgaaacatgcatgcgacatacttgacgaacttcacattccttatgaaaaacaggtagtatccgcgcatcggacgcctgatttgatgtttgaatatgcagaaagcgccagagacagaggcttaaaagtcattattgccggagccggtggagcggcgcatctgccgggtatgacggcggccaaaacgacactgccggtgatcggcgtaccggttcagacaaaatcgcttaacgggcttgattctcttctgtctatcgtacagatgcccggcggcgtgccggtcgcgacaacggcgatcggaaaagcgggcgcagtgaacgcgggtctgttagccgcgcagattttgtcggcatttgacggtgacattgcggataaactagaggcgagaagaaatgcgacaaaacaaacggtgctggaaagcagtgatcagcttgtctgataaaaaaacgatttatcccggcgccgtcatcggcattatcggaggcggacagctcggaaaaatgatggctgtcgccgcaaaacagatgggctataaagtcgcagtcgtcgatcccgtgaaagactcgccatgcggacagatcgccgatattgagattaccgcccagtacaatgaccgtgaagcgattcaaaaattggccggagtcagtgacatcattacgtacgaatttgaaaatatcgattacgaggcgctcaactggctcaaagaacatgcatatcttccccagggaagcgagctgctgcttatcacccaaaacagggaaacggaaaaaaaggcgatccagtcagcaggctgtcaagtcgctccttatcggatcgtaaacagcggacgggagcttgaggaagctgttcaggcactggggctcccggcggtgctgaaaacatgccgcggcggatatgacggcaaaggccaatttgtcattaaggaagaaggacagacagacgaagcggccgcgctgctagaaaacggcacgtgcatactggaaagctgggtatcgttccggatggagctttccgttatcgtgacgagatcggtgcacggtgagatttcaacctttccggctgctgaaaatatccacaaaaataatattctgttccaaagcatcgtgcccgcgagagcggaggaaacggttcaaaagcgggcagaggcgcttgccgtccagctcgcggagaaattggagcttgtcgggccgcttgcggtggaaatgttcgtcacagaagacggagaccttttgatcaatgaactggcgccgcgtcctcacaactccgggcattatacgctcgacctttgtgaaacgagccaattcgaacagcacatcagagcggtctgcggacttcctctcggcagaaccgatcttctcaaaccgggaatgatggtgaatctgctcggtgaggaagtgaagcttgcggaggagcatacggagcttttaaaagaagccaaactgtacctgtacggaaaacatgagattaaaaaagggcgcaaaatggggcatatgacatttttgcggaagcctgatgaaacatggattcaggacatcacgaacatatggatgaaaagagacggaggacgagcataatgatcgaacgttattcaagacctgaaatgtccgcgatctggacggacgaaaacagataccaggcatggctggaagtcgagattttagcctgtgaagcctgggctgagcttggcgtcattccgaaagaagacgtcaaggtcatgcgcgaaaacgcgtcttttgacatcaaccggattttggaaatcgagcaggatacgcgccatgacgtcgttgcatttacccgcgcggtttcagaatcattaggcgaagaaagaaaatgggtccactacggcctgacgtcaacagatgtcgtggataccgctctttcctatctattaaaacaggcgaatgagatcttgctcaaggacattgagagatttgttgacattataaaagaaaaagcgaaagaacataaatacacggtcatgatgggccgcacgcacggcgtacacgcggaaccgacgactttcggcctgaagctcgcgctttggcacgaagaaatgaaacgcaaccttgaacgtttcaagcaggcaaaagaagggatcgaagtcggcaagctttccggcgcggtcggcacatatgcaaatattgatccgttcgtagagcagtatgtctgtgaaaaactcgggctgaaagcggcgccgatttccactcagacattacagcgcgaccgtcatgcggattacatggcggcactggctttgatcgcgacgagcattgaaaaattcgcagtggaaatccgcggtctccaaaagagtgaaacacgtgaagtggaagagttttttgctaaaggacaaaaaggctcatcggctatgcctcataaacggaatccgatcgggtcggaaaatatgacgggcatggcgcgcgtgatccgcgggtacatgctgacggcatacgaaaatgtaccgttatggcatgagcgtgatatttctcattcatcagctgagcgcatcattcttcctgacgcgacaatcgcgctgaattacatgctgaaccgattcagcaacatcgtcaaaaacttaacggtattcccggaaaatatgaaacgcaacatggaccgcacactcggtttaatctattctcagcgcgtgctgcttgctttaatcgacacgggtctgcctcgtgaagaagcatatgacacggttcagccgaaagcgatggaagcgtgggaaaaacaagtgccgttccgccagcttgtcgaagcggaggaaaaaatcacgtcccgcctcacaccggaacagattgccgattgctttgactacaattatcatctgaaaaacgtcgacttgatctttgagcgtttaggtttatagaagaagccagccggaggcggcttcttcagccgccgtagattgaatattcccaacattcgggttaggaggccttccgtgaatattgtgaacaataatcttctttatgaaggaaaagcgaagcgaatttatcaaactgaagacgaacagattctccgcgtggtctacaaggattccgcaacagcctttaacggtgagaaaaaagcggagatcagcggaaagggccgtctgaacaatgaaatttcaagcctgattttcaaacatctgcacgccaaaggaattgacaaccactttgtggagcgtgtttcagaatcagagcagctcatcaaaaaagtgagcatcattccgcttgaagtcgtggtcagaaacattgccgccggaagcatgtcgaaacgtctcggcatcccggaaggaacagagctcccgcagccgattatcgaattttactacaaggatgacgcactcggcgatccgctcatcacagaagatcatatccggctcttaaaagcggcggctcctgagcatgtcgaaacgatcaaatcgattacaaaccaggtgaatcaagaacttcagcatatttttgaagactgcggggtcagattaatagattttaagctggaattcggcttagacgcagagggacgggtgcttttagcggatgaaatttctcctgacacgtgccgtctgtgggacaaagacacaaacgaaaagctcgataaagatttgttcagacggaacctggggagcttaaccgacgcatacgaagagattttcaaaagactgggaggcatttcataatgtataaagtgaaagtttatgtcagcttaaaagaaagtgtgctcgatcctcaaggaagcgcagtgcagcatgcattgcacagcatgacctacaatgaagtgcaggatgtgcgcatcggaaaatacatggagctgacgatcgaaaaatctgaccgcgatcttgacgcgctcgtgaaagaaatgtgtgaaaagctccttgccaatacagtcattgaagactaccgatatgaagttgaggaggttgtcgcacagtgaaatttgcggtgattgtgttacccggctccaactgtgatattgatatgtttcacgccgtaaaggacgaactcggcgaagaagtcgagtatgtctggcacgaggaaacaagccttgacggatttgacggcgtgctcatccccggcgggttttcatacggcgactacttgagatgcggcgccatcgccagattcgcaaacatcatgccggccgtgaaaaaagcggctgccgaaggaaaaccggttctcggcgtctgcaacggattccagattctgcaggagctcggacttctgcccggcgccatgagacgcaacaaagatttaaagttcatctgccgcccggttgaattaatcgtacagaacggcgatacgttattcacatcttcctatgaaaaaggacaatcgattacgattccggttgcccacggcgaaggcaatttctactgtgatgacgaaacgcttgaaagattaaaagaaaacaatcaaatcgtcttcacatacggcggcgatattaacggaagcgtcagcggcattgccggcgtcgtgaatgagaaaggcaacgtattaggcatgatgcctcaccctgagcgcgcagtcgatgaactgctcggcagcgcagacggtcttacattgttccggtctatcgtgaaaaattggagggaaactcatgtcgctactgcttgaaccaagtaaagaacaaataaaagaagagaaactctatcagcaaatgggtgtcagtgatgacgagttcgcactcattgaatctattatcggaagattgccgaactacacggaaatcgggattttttccgtgatgtggtcagagcactgcagctataaaaactcaaaaccggttttacgcaaattcccgactagcggcgaacgcgtgctgcagggtcccggagaaggcgcgggaatcgttgacatcggtgacaatcaggcggtcgtgttcaaaattgaatctcataaccacccgtcagcgcttgagccataccaaggtgctgcgacgggagtgggcggcattatccgtgacgttttctcaatgggcgcccgtccgatagctgtattaaactctcttcgatttggtgaactcacttcacctcgtgtgaagtacttgtttgaagaagtagtggcgggaatcgcgggatacggaaactgtatcggcatcccgacggtcggcggagaagtgcagtttgacgcaagctatgagggcaatccgcttgtcaatgcaatgtgcgtcggcttgattgatcataaagatattaaaaaaggccaggcgaaaggtgtcggcaacacggtcatgtacgtcggcgctaaaacgggccgcgacggcatacacggcgctactttcgcatcagaagaaatgtcagattcatctgaagaaaaacgttccgcggtgcaggtcggcgatcctttcatggaaaaacttctcctggaagcatgccttgaagtcatccaatgcgacgccttagtcggcattcaggatatgggggcggccggtctgacaagttcgagtgctgaaatggcaagcaaagccggctccggcattgaaatgaaccttgatctcattccgcagcgggaaacgggtatgaccgcttacgaaatgatgctttccgagtctcaggaacgcatgcttctcgtcattgaacgcggacgtgaacaggaaattgtcgatatttttgataaatatgaccttgaagcggtttccgtaggtcatgtgacggatgataaaatgctccgcctccgccataacggagaggttgtttgcgaacttccggtcgacgcactggcggaagaagcgcctgtataccacaaaccgtcagcagaacccgcgtactaccgcgagtttcaggaaacagaagttcccgcgcctgaagtaaaagatgggacagagacgctttttgccctgctgcagcagccgacaattgccagcaaagagtgggtgtatgatcaatatgactacatggtgcgcacaaatacggtggtcgctccgggctctgacgcgggagtgctcagaatccgcggcacgaaaaaagcgctggcgatgacgacggattgcaacgcccgttatttatatcttgatccagaagaaggcggaaaaatcgccgttgccgaagcggcgcgcaacatcgtatgctccggcgccgaaccgcttgcggtcacggataatctgaatttcggaaacccggaaaaacctgaaattttctggcagatcgaaaaagcggccgacggcatcagcgaggcgtgcaatgttctcagcacacccgtcatcggcggtaacgtatcactttataatgaatcgaacggaacggctatctacccgacgcctgttatcggcatggtcggcttaattgaagataccgctcatattacgacacagcatttcaaacaagcgggggatcttgtatacgtgatcggcgaaacaaaacctgagtttgccggaagcgaactgcaaaaaatgacagaaggccgcatttacggcaaagcgccgcaaatcgatcttgatatagagctgtcacgccaaaaagcattgcttgacgcgattaaaaaaggcttcgttcaatccgcgcatgacgtatctgaaggcggcttaggcgtagcgattgcagaaagtgtcatgacgacggaaaaccttggcgccaacgtgactgttgaaggggaagcggcattattattctctgaatctcaatcccgcttcgtcgtttcggtcaaaaaagaacaccaagcggcgtttgaagcggctgcggctgatgcggttcatatcggtgaggtaacggctgacggacttctggcgattcaaaaccaggacggacaacaattggttcacgcgcaaacgaaagaacttgagcgcgcgtggaaaggagctattccatgcttgctgaaatcaaaggcctgaatgaagaatgcggtgtgtttggcatctggggacatgaagaagccccgcaaattacgtattacggtctccacagcctccagcacagaggacaggaaggcgcgggaattgtcgcgactgacggcgaaaaactgacggcgcacaaaggccaagggctgatcactgaagtatttcaaaacggcgagctcagcaaagtaaagggaaaaggcgcgatcgggcatgttcgttacgcaacggctggaggaggcggatatgaaaatgttcagccgctcctgttccgttcgcaaaacaacggcagcctcgcgctcgcccataacggaaacctggtcaacgccacacagctgaagcagcagcttgaaaaccaagggagcatttttcagacttcctccgatacggaagtgctggctcatctgattaaacgcagcggacacttttcgctgaaggatcaaatcaaaaattcgctatctatgctgaaaggcgcttatgcctttttaatcatgactgaaacagagatgatcgtagcgcttgacccgaacggactcagaccgctgtcaatcggcatcatgggcgatgcttatgtggtcgcttcagaaacgtgcgcatttgatgttgtcggcgcaacgtaccttcgtgaggtagagccgggcgaaatgctgatcatcaacgatgaaggcttgaaatcagagcgtttttccatgaatatcaaccgttccatctgcagcatggagtacatttatttctcaagacctgacagcaatatcgacggcattaacgtgcacagcgcccggaaaaacctcgggaaaatgcttgcccgggagtccgcggttgaagcggatgtcgtcacaggcgtgcctgattccagtatttctgcggccatcggctatgccgaggcgacgggcatcccgtatgaactcggtctcattaaaaaccgttatgtcggcagaacgtttatccagccgtcacaggctctccgtgagcaaggcgtcagaatgaagctgtccgccgtccgcggtgttgtcgaaggaaaacgggtcgtcatggttgatgattccatcgtgcgcgggacgacaagccgccggattgtcacaatgctcagagaagcgggggcgacagaggtgcacgtcaagatcagttcaccgccgatcgctcatccgtgcttctacggtatcgacacatcaacccatgaggagctgatcgcttcttctcattccgtggaagaaatccgtcagatcatcggtgccgacacgctttctttcttaagtgtagacggattgttaaaaggagtcggccgaaaatttgaagacaccaattgcggacaatgcctcgcttgttttacgggcaaatatccgacggaaatttatcaggatacagtgcttcctcacgtaaaagaagcggtgctgacaaaataaaatgtgaaaatgacataaaggcagcgggaattcaggctgcctttctctttctgcctttttaggagaaacgaattgacaaggagtgatagggatgtctgatgcttataaaaatgccggagttgacatcgaagccggatacgaagccgtcaaacgaatgaaaaaacacgtggagcgcacgaaaaggctcggcgttatgggaagcctgggcggttttggcggaatgtttgatctgtcagagcttccgtatcaaaagcctgttttaatttccggaacagacggtgtcggcaccaaactgaaactcgcattttcaatggataagcatgacacgatcggcgtcgatgcggtcgcgatgtgtgtaaacgatgtgcttgcccagggagcggagccgctgtttttccttgattatttggcggtcggcaaggctgatccggtgaaaattgagcagatcgttcagggtgtggcggacggatgcgagcagtcaggatcagcgcttatcggcggtgagacggcggaaatgccggggctgtatacgtctgatgaatacgatattgcgggcttttcagtcggcgtcgcggaaaaagacgaaatcgtcaccggtgaacatatcgaagaggggcatctcttaatcggacttacttcaagcggccttcacagcaacggattttccctggtgagaaaagtgcttcttgatgacggcggacttgatttggatactgtctatgaaccgtttgcgcgtcctctcggcgaagaattgctggaaccgacgagaatatatgtgaagccggtgctcaaggcggtgaaaagcggtaaggtggacggcatggcgcatgtgacaggcggaggattcatcgagaatatcccgcggatgctgccggacggattgagcgcggaaattgatcacggatcatggccgatcccgccgatttttccgtttctgcaggagcacggcaagctgaaagaagaagaaatgttcaatgtctttaatatgggcatcggttttgtccttgccgttaaagaagaaaacctgacagacgtcatcggcacgcttgaagctcagggcgagaaggcttatctgatcggccgggtcaagcggggcgaaggcatttctttcggcggtgcggctctttcatgaaaaagtttgcggtatttgcttcaggaaacggatcgaacttcgaggccattgccaaacgcatgagagaagagaagtgggatgcggagctctcgcttctcgtgacggataagcctcaggcaaaggcggcggaaagggcggaggctttacatatcccgtcattcgcctttgaaccgtcatcttttgaaaacaaagcggcctttgaacgggccattattgaacagctgcgcctgcacggggcggaattaatcgttctcgccggctatatgagactgattggagatacgctgcttgaagcatacggaggacgcattattaatatacatccctcgcttcttccggcattccctgggattgacgctgtcggacaggcgtatcgggccggtgtgaaagtggcgggcattaccgttcattacgtcgacgaaggcatggacaccggaccgattatcgcgcaaaaagcattcgaaatacaggaaaacgatacgcttgaagacatagagcatacaatacacgagcttgagcacaaatggtatccgagcgttgtgaaacggctgctgggactaaataacagaggtgaaaaggcatgacaatcaaacgcgcactaatcagtgtttctgataaaacaaatctcgtacctttcgtaaaggaactgacagagctcggcgtcgaagtcatttcgaccggaggaacaaaaaaacttcttcaggaaaacggtgtggatgtcatcggcatttcagaagtgaccggatttcctgaaattatggacggacggttaaaaacactccatcctaatattcacggcggtctgcttgccgtaagagacaataaagagcatatggcgcagatcaatgaacacggcattgcaccgattgaccttgtggtcgtcaacctttatccgtttaaagaaacgatttcaaaagaagacgtaacatacgatgaagcgatagaaaacattgatatcggcggtcccggcatgctgcgcgccgcatcgaaaaaccatcaggatgtgacggtcatcacagatccggccgattacagctccgtgctcaatgagatgaaagaacacggcggcgtttcgctcaaaagaaaacgcgagcttgcggccaaagtattccgccataccgcggcatacgacgcattaatcgctgattacttaacacgcgaggccggtgagaaagaccctgagcaattcactgttacttttgagaaaaaacagtcgctccgctacggtgaaaaccctcaccaagaggcggttttctaccaaagcgcacttcctgtctccggttccatcgcagcggcaaaacagcttcacggcaaagagctttcttataacaatattaaggacgcggatgcggctgttcaaatcgtccgggaatttacagaacccgcagctgttgccgttaaacatatgaatccatgcggagtcggtacgggagcttcaattgaggaagcattcaataaagcgtatgaagctgataaaacctccattttcggcggcatcatcgcgctgaaccgtgaagttgatcaggcaacggctgaagcccttcacggcatctttttagaaatcattatcgccccttctttcagtgaagaagcgctgaacgtgctgacggcgaagaaaaaccttcgtctgctcacgcttgacgtgaccgcatcaggaaagaaagaaaaacagctgacttccgtacagggcggtcttttgattcaagatttagacgtccatggatttgatgacgccgacatcaccatcccgacaaaaagagagccgagcgagcaggaatgggaagatttgaagctggcctggaaagtcgtcaaacatgtgaaatccaacgcgatcgtccttgcaaaagaccatatgacggtcggtgtgggcgcaggacagatgaatcgcgtcggttcagccaaaatcgccattgagcaggccggagaaaaagcaaaaggcagcgcgctcggatcagacgcgtttttcccgatgccggatacagtcgaagaagccgcaaaagccggtgtcacggcgattatccagcccggcggatcggtccgcgatgaagattcgattaagaaagcggatgaatacggaatcgccatggtattcaccggcatcagacatttcaaacattaaggggggaacgaagcgtgaatgtattgattatcggaaaaggcggcagagagcatacattggcttggaaagcggcgcaaagcccgcttgttgacacggtgtacgccgcgcccggaaatgacggtatgacagactgcgcgacgctggtcaacattggagaaagcgatcatgccgcactcattgcgtttgcgaaagaacatcatgtcggcctgacgattatcggccccgaagttcctctgattgaagggatagccgacgagtttgaaaaagccggactgcttgttttcggaccgtctgaaaaagcggctattattgaaggaagcaaacagtttgccaaggatttaatgaaaaaatacggcattccgacggcggagtacgagacgtttacttcatttgaagaggcgaaagcatatgtacagcaaaaaggcgcgccgattgtcattaaagcggacgggcttgccgccggaaaaggtgtcacagtcgcgatgacggaagaagaagcgattgaatgcctgcacgattttcttgaggatgagaaattcggggaggcgagcgcatctgttgtcattgaagagtttctcgccggcgaagaattttctttaatggcgtttgtaaaaggggagaccgtctatccgatggtcatcgctcaagatcataaacgcgccttcgatggagacaaagggccgaatacgggcggaatgggagcctactcaccggtgccgcacatttccgatgatatcgtcagaagcgcagtcgaaacgattgtgaagccggcggcaaaagcaatggtgaaagaggggcgctccttcacgggcgtgctgtacgcggggctgattctgacggaagacggatcaaaggtcattgaattcaacgcgcgcttcggagatccggaaacacaggccgtcgtgccgagaatggaatcggacctcattcaggtgctcttagatcttctgcatgagaaagatgttgacctaagatggaaggatacggccgcggtcagcgttgtcctggcttctgaaggctatccggaaggctatgcgaaagggacgccgatcggcagtttgacgtccgctgaagacgggatcgccgtttttcatgccggaacgaaaaaagacggcggacaatttgttacgaacggcggccgggtcgccaatgtcacggcatttgctgagacatttgaagcggcgagggataaagtgtacagcgccgtttcggggctgacaaaacccggactgttttacagaagcgatatcggcgcccgtgcgctgaaagcatcgcagcgataaagaggaaacccccgcgtcttaaaagatgcgggttttcttctgaatgacgactaagattgtcatgcagtcttgaattctgtcccggcttttgtgatgccgggatcgccggcagattcttctcatactcgcgggacaggagaaaaaaataacaagccgaaacggcttgttatttttcttgctgatggctgtcatcctgattcattccggcttggaacatatatgtcaccggacagaagcggaggatgccggacgccgctttcatcgcgcccatcatcatacagaagagatgcatcttgcaccaaggttttctcgtgtattttgctgaagcggcagacaaaatggtgaggccgcaagtgatgcgcataacggcgtttaataaactgatattcggtttcatcatttcagctcccttagaaaaagtttttcattcatcttcaataatttgtaacgttttagccgtgcgataattgtgcggatgtgatacgatgggtctaatataagcgaaggagagtatgtgaatgtccgaacgtacctttaactggaaaaataaagacatcagatcacaggcggatgttgtagactcaaagctgcttccaacgctacttttacgggatgctctcgtattaaatccttttttaaaacaatggctgaaaaagaacgtctggatttacggagaccgaattgtatatgttggtcatgagcttcctgatgcagcagagcacattcataccataaattgtgaaggaaaatacattgtgccaggttacattgaaccgcatacacatccttttcaaatatataatccccaaacgctcgccgaatatgtgtctcaattcggaacaacgacgtttgttaatgataacttgttttttcttttgcacagcggtaaaaagaaagcgcttactatattggaagaactaaaaaaacagccggtgcaatatttctggtggtccagatatgatctgcagactgaagtgctgaatgaggaccagctcctttcttttgatgtccgcaagcaatggattgagcatccggatgtcattcaaggcggagaattgaccggatggccgcgcctcatggacggcgatgacttgatgcttcattgcatgcaggcgacaaagaaactgcgcaagcggatagaagggcattttcccggagcttctgaaaaaacactgacgaagatgaaactgttcggggctgattctgaccacgaggcgatgaatggcgacgaggtgatgagacggcttgaattgggttactatgtttcgctcagacattcatccatccgccctgatttgagaacgattttgcaggatctccatcaaaaaggcttccggcattatgatcatttcttttacacgacggatggagcgacgccgcatttttataaaggcggcatgacgaatgaattaatcaaaatcgctttggaggaaggggttccggcgattgacgcctacaatatggcctcctttaatatcgcgaaatattatcagatggatgactttctcggtgtgatcggtccgggccggcttgcttcattgaacattctcgatgacccgatgaatccggacccggtcacggtgatctccaaaggcatcctgctgagggaagacggccgaaatatgaatgcgtttacagaaacggattggaaaaagggcggtcttgtccctcttgagctttcatatgatatgacgatggatgatttacagttttcaatgccgatgggtgtgataatgcgcaacgccgtcattatggagccgtatatgattgcgattgataattctgttgaccagctttcttttgatcatgatgaatgctatctcacgcttctcgataagcatggaaaatggcgggtcaatacaatgctgaaaggttttgccgatcgggtgcagggctttgtcagttcctacacgacaaccggagatattatcgctgccggaaaaaataaagaagatatcctgctcgctttctcacggatgaaagaaatcggcggcggaatcgtgcttgccgaaaacgggaaggttcttcatgagattcccctcgctttaaacggttctgcatccgcggagaattatgaagaagtgcttgagaaagagcaaaaactgaggacgctgctggaggagcggggctaccgattctgcgatccgatctatacgctgctctttttgcagagcacacacctgccttatatccgcattacgccgagaggaatattcgacgtgatgaaaaaaactgtactctttccatcgataatgcgttaaaatataaaagcagggagccgacatatgaaaagatggaaaaccgtttgtatgctttgttttgcgtttttgctgcttgccgcctgccggcagaacaatgccgatcaggtgcagccgaaagaagcggaagctcctttaacggggctgaaaactgagcagaagcttgcagaacgccgtccgattgcagtcgcagtgaacaatcatccgaaggcgaggccccaatccgggctgtcaaaggcggatgttgtcatcgaagcgctcgcggagggccggattacgcggtttctcgcgatttttcaaagtgagatgccggaaacggtcgggcctgtgcggagcgcgagggaatattttgtcacgctcagcagcgggtttaacagcatatttgtccatcatggctggagtcccggcgctaaaaagcagctggagtccggaacttacgattatataaacggtttggattttgacggcagcctgttttggagagccgatttcagcaagccgccccacaattcctacacgtcgtatgacaatatcaggaaggcggcggaacaaaaaggatacaagctgaacggaaaaacagaaccgctcccatttcagacatcagatgcaaaacccggaaacgaaacctacaatattcggatagattatggaacacaaaacgttacaaatcttgtcgaatacgattatgataaaaaagctgatgcttatacaagaagctctgatggtgtgaaagcgacagaccgggagaccggaaagcctttagccatgcacaacatttttattgttgaagccggccatcgcatgacagacaaagatggaaggcgggccatcgatattcagtcagggggaagggcctcctgcttcagcacggcgatgttatggagtcagactgggaatataaagacggccgtattctgcccgtaaaaggcggtgagattcttccgtttgtgccaggaaagacatggattaatatcgtgcctgatctcgatgcagcttccattagtaaaggagaaggtgtttgacgatgcaaatcgataaattacgcggaaaagaactggaccagttatttttatctattttatcgctgaaagatctggaggaatgctatcgtttctttgacgatctttgtacgattaatgaaatccaatcgctggcgcagcgtttggaagtggcgagaatgctccgcgaaggaaatacgtatcacaaaattgaaagcgaaacgggtgcttccacagcgacgatttcccgggtgaagcgctgcttaaattacgggaacgacgcctatgaaatggcgcttgaccgcgtaaacaaaggagaatcctcctcagctacgtaaaaaaccgctctgccgatgacggcaggcggtttttttatgcgtgctgattcaaaaggccgggaagttccctcaggcttccgtcttcctcccggtatacgatgtgttcagctgagaaatgaatcggcgagctgatacccgccgccgcggcaagatgaaacagcccttcacgcaacgagagcacgtagttgcagacgcgatgctgtttatcctcgatactgagcgcgcgctgaagttttggatcggttgtcgccactccgacaggacaatgattggtgtggcatacttgagcgcggatacagccgactgaaaacatcattccccgggcaatattgacaaaatccgcgcctaacgcgagggcaacggcaatcttatcgggagtgagcagctttccggatgcgaaaattttcagcctatctcttataccgtatgtcttcaaaaggccgtcaacaagggggaggccggtcagaatcggcaggccgacggaatccgccagctcatggaaagaagctcccgttcccccttcactgccgtcaatcgtaataaagtcgggaagtttgcctgatgaactcatacaggaaataaggtcttcaaggtctttgcggctgcccgggacaattttgatgccgaccggtttttcaccgacagttcttaatttctcaatgaaatcaagcatgtccggaacatttgagaactcgttgaagcggtttggactgtcaatggattgtccgggctgcacatttctgatggcggcaatttcttcggtcacctttgaaccgtcaatatgaccgcctctagctttcgccccttgcgcaagctttaattcaaaggctttaatctgctcgaggcggctttttttcttaaattcttcccatgaaaattctccatcttcagtgcgcacgccgaacagcccggggccgatttggcagataatatccgcgccgcctttcaagtgatactcagacaggccgccttcgcctgtattcatccatgtgccgccggcctggtgcagcccttttgacagggcggtgattgcccggtcgccaagtgagccgtagctcatcgctgattgtccgattaacccttttacataaaacggtttcttgcatgtgtcgcggccgatcacttgcacatcgtccggatgcaggtaataagggtccgcttttgctttttcgcggtgttcgctgcgtttcagcaggttgtctttgtcaatcttgtataccatcgtgtcgatcttcggcgtctgatctgtgcgcagctcctccctttgtttcgggaagagggcgttacggatataatagcccggctgatcgaaatcccgttctgagccgaagcccatcattctgcttttatactttcccgacatgaccgtctgttcatattctctccgggaaaacggctgttcttcgttatcattgctgaataaatactgccgcagctcaggtccgattttttcaaatatatagcgcagttttcccgctgcgggataattgcgcagcactgaatgttcttcctgcttttcgtctcttatgtaaatccagagaaacaatgcggcgggaactaaaataataaaaatcaatatacaaatcagtacgataatggcttgttccattgagatcagactccttgccttttttctctttgacattccacattttgtctgttttcaaacatagccgtttcccgtccggcggagcgcaatctttttttgtgaatcaggtgaatgacgtctttttccgtttttccgggccaaacgaatttgttataatgtttaaatggcaagaaacgaatggaggaacgaaaacgcatgtacgatgttaacgagtggaagcatgtttttaaactcgatccgaataaagatttaccggatgaacagctggaacggctttgtgaatcagggactgacgccattgtgatcggaggaagcgacaatatcaccgaggacaatgtgctgagactgatgtcaaaggtgcggcggtttttagtgccgtgcgtacttgaggtgtcgacgattgattccattgtgcccgggtttgatctttatttcattccgagtgtgctcaacagcaaaaaggcggactggattgtcggcatgcatcatcaggcgatgaaagaatacggagagctcatgtcaatggaggaaatcgtgacggagggctactgcatcgtcaaccctgattgtaaggcggccgctttgacggaggcggatacacatatagaaacagaagatattctcgcctatgcgcgggtcgcggaacatttgcttcatctcccgattttttatctggaatacagcgggatgctggcggacatagaaacggtggagaaaacgaaggctgtgctggacaagtccgtcctgttttacggaggcggcattaaagacgcggaaacggcggaacggttcggccgtcatgccgatgtcatcgttgtcggaaatgccgtatatgaagattttgatcaggcgctcaaaacggtggcggctgtaaagacaaagtagccaagcggacgaaattgatttatgatagaacatatgtttgataggcggtgaacggatatgaattacattagcaatcaattattaagcggattaaatcccgttcagcaggaagcggtcaagacgacggacggtccgctgcttctgatggcgggcgcgggaagcggaaaaacacgtgtgctgacgcacagaatcgcatacttaatggcggaaaaacacgtggcgccatggaacattctggcgattacctttacaaataaagccgccagagaaatgaaggagcgggtggagagcattctcggacccggcgcggatgaaatctggatttccaccttccacagcatgtgcgtgcggattctgcgcagggatattgacagaatcggcatcaaccgaaacttctccattcttgatacggctgatcagctttccgttattaaagggattttgaaagagcggaatatcgatccgaaaaagtttgatccgagaagtattttaggctccatcagcagcgccaaaaacgagctgatcgaacctgaggaattcgcaaaaacggccggcggctactacgatcaggtcacgagtgacgtgtataccgattatcagaaaaaactgctgaaaaaccaatcgctcgattttgatgatttaatcatgacgacgattaagctttttgagcgtgtgccggaagtgcttgagttttatcagcgcaaattccagtacattcacgtagacgagtatcaggatacgaacagggcgcaatacctccttgtgaagcagcttgcggcccgtcttgaaaatatctgcgtcgtcggtgactccgaccagtccatttacagatggcgcggggcggatatcgcgaatatcctttcctttgaaaaagattacccgagcgcaaacgtgattctgctcgagcaaaactaccgctcaacaaagcggattctgcaggcggctaacgaagtgatcaaaaacaactcaaaccgcaagccgaaaaacctgtggacggaaaatgacgaaggcatcaagctttcttattacagcggcgacaatgaattcggcgaaggccaattcgtcgcgggcaaaatttatgagctgcacagctcgggccggcggaagctttccgatatcgcgattttataccggacaaacgcccagtcgcgcgtcatcgaggaaacccttttaaaatccggtctgaactacaatatcgtcggcggaaccaagttctacgacaggaaagaaattaaagacattcttgcatacctgcgccttgtgtcaaacccggacgacgacatcagttttacgcggatcgtcaatgtgccgaagcgtggcgtcggcgccacttcgctagaaaaaatcgcttcatatgcggcgatgaacggaatgtcaatgttccaggcgatcaaacaggttgatttcatcggtgtcagcgcgaaagcggcaaacgcgcttgacggctttggcgcgatgattgaaaatctgacgaacatgcaggattacctgtccattacggaactcacggaagaaattctcgaaaaaacggaatacagagaaatgctgaaggccgaaaaatcaatcgaagcccaaagccgccttgaaaatatcgacgagtttctttccgtgacgaaaaacttcgaacaaaaaagcgaagacaagtctctcgtcgcgtttctgaccgatctggcgctgatcgcggatattgaccagctcgaccagaaggaagaagaagcaggcggaaaggatgccgtcactttaatgacactgcacgccgctaaggggcttgaatttccagtcgtgttcttaatgggcatggaagaaggcgtgttcccgcacagccgctccctgatggaagaagccgagatggaagaagaacgcaggctcgcatatgtaggcattacgagggcggaagaagaactgtatttaacgaatgccaaaatgcgaaccttattcggccgcaccaatatgaatccggaatcccgctttatcagggaaatacctggcgatttattggagaacctaaatgagaagaaaacacctcgcatgcagccgggaagaaaagtgcagccgaaacgcgggcccgtatcccgtcccgtttcctatgcgaacaaaacaggcggcgactcgctcagctgggcggtcggcgataaagcgggccataaaaaatggggcaccggaacggttgtcagcgtaaaaggagaaggcgaaagcaccgagcttgatatcgcattcccgagcccagtcggcgtgaagcgtctgcttgccgcttttgcgccgattgaaaagcagtaacctgaagaggaaaggaagaacatgatggacaaagaaacagcgaaacaccgggcagaagaattgcgccgcaccatcgatcagtacagttatgaatattacaccttagatgaaccgagcgtgccggattccgagtacgacagactgatgcaggagctgattgccatagaggaagagcacccggaactcagaacgcctgattcgcccacacagcgggtcgggggagcggtgcttgaatcttttcaaaaggtgcagcacggcacgccgatgctcagtctcggcaacgcatttaacgatgatgatctccgcgattttgaccgccgcgtccgtcaggctgtcggtgacggcgtcgcttacaatgtggagctgaaaatagacggtcttgctgtttctctccgttatgaagacggctatttcgtcagaggcgcgacaagaggagacggaacgacgggcgaagatatcaccgaaaacttaaaaacgatccgcaacattccgctgaaaatgaaacgtaatctttccatagaagtgcgcggagaggcgtacatgccgaaacagtcatttgaagcgctcaatgaggaaaggctgaaacatgaagaggagccgttcgccaatccccggaacgcggctgcgggctcactcagacagctcgatccgaaaattgcagcgaaacgaaatcttgacatcttcgtctacagtatagcggagcttgacgagatgggtgtggaaacacagagtcagggcctggattttctggatgagctcggttttaaaacaaaccaggaacggaaaaaatgcgacacgatagatgaagtcattgaaatgatcgaagagctgcaggcgaagcgggccgatctcccttatgaaattgacggaatcgtcatcaaagtcgattcgctcgaccagcaggaagaactcgggtatacggcaaaaagcccgcgctgggcgattgcttacaaattcccggctgaagaggtcgtgacaaaactgctcgatatcgaactgaatgttggaagaacgggcgttattacgccgaccgccgttctggaaccggtaaaagtcgcgggaacgacggtctcaagagcatcccttcataacgaagatttaattaaagagaaggatatccgcattctcgataaagtggtcgtcaaaaaagcgggcgacatcatccctgaggtcgtcaatgtcttaattgaacagcggaccggggaagaaaaagaattcaatatgccgaccagctgccctgagtgcgaaagcgaacttgtccgcattgaaggggaagtcgcgctgcgctgcatcaatccggaatgtccggcgcagatcagagaaggcctgattcactttgtctcacgcaacgcgatgaatattgacggactcggagaacgtgtcatcacacagcttttccgtgaacatctcgtccgtaatgtcgctgatttgtataagctgacgaaagaacaggtcatccggcttgagcggatgggggaaaaatcaactgacaatctgatcagctccatccaaaagtcgaaagagaattcgctggaacgcctgctgttcggtctcggcatccgttttatcggctcaaaagcggccaaaacactggccatgcattttgaaagcctggaaaatctgaaacaagccacggaagaagagctgcttgcggtagatgaaatcggcgaaaagatggccgatgccgttatcacctatttccgcaaagaggaaatgcttgagcttttgaatgaacttgaggaactcggtgtgaacacactctacaaaggcccgaaaaaagtaaaagcagaggacagcgactcttattttgccggcaaaaccatcgtgttaaccggaaagcttgaagagctgtccagaaatgaagccaaggcgcagattgaagcgctcggcggaaagctgacgggatctgtcagcaaaaaaacagacttgctgattgccggagaagcggccggaagcaagctgacaaaagcgcaggaattaaacattgaagtatggaatgaagcacagctattgggagagctaaagaaataagaggagtgttttctattgaaaaagatgttggcattggcggcgacggcaacggcggcagtactcatgctgtcggcctgttcgccgagtttcgggggaaaaaaagaggaagagatcacgcagaaaacggcaaagtcttctgaaaaagcgatcataccgaaatataatatctctgattcctactataaaatggtgctcccgtttaaggccggaaaagcgcgcggcctgaccgcggaccggctgaacacgaggctggacatcgatgaattcgagactgggctgatgcggctcgctcaagacacgttcccgacggatgactatttgtatcaggaaggccagtatttagatgaggacacggttctcagctggcttgaccgcaaaaaagagggcagtgatctgaaaaaggcgaaaaaggcagacgccaatttccagaatctcggcttaaacccggtgctgccaagctcgggatcagcaaaagagaaaaacgaaaacagcccgatttacttagcgtccatgcttgagcaggattacttagtaagaaaagataaaaattccatccagcttggcggtgtcatgatcggtctcgctctcaactctgtatactattaccgcgaaaacacaggtgatccgcagcaggaagtggagctcagcgacaaaacgatccgcagccacggcgaagaaatcgcacaggaagtcgttaaccgccttcggaaaatggataacctgaaaaatgtgccgattaccgtcgccctttataaacaagcgccgaaaacatcaatcgtaccggggaattacattgcgaaaacagaagtcaaggccggctcatccaccatttcaaactgggatgatgtcaaagaaaagtacgtcttctatccggcggatacagacacggcaaagaaataccctgatgattccgaagtgtttaaacgcttcaaaaacgccatcgacagctacttcccgaattacaccggagttgtcggaacggcaatgtacgaaaacgatgaaatgagaaaaatgaagattgaaatcccgatgcaattttacgggaaaagtgaagtcatcgccttcacccaatacttaacaggtgagctgatggattattattcaaaaggctcagttgatgtcgaaattaacattacctcgtctgacgggcaggaagcgctgatcgtccgcaatgcgggtgacaaagaaccgaccgtccatatttacgattaaccaagatgcccttgttcatttctgtatgagcaagggttttttagtgtgaatatcgttggagagaggaatgaggtatgttaagatatttgtataattaggaattaacaggaaaacacatatcatttctaagcggatgttacgaatctgctgtgaaaaaagaagggcaggaatgttgatgaatgacatttgctgagtacacacaccgcctacaaatgttatgaaaagggtgaatcagcatgcataaagatattaaagcgatttttgaggaagataaggtgctggctgaagccggtgaaatatacggatttaccaagtttcaatttattgcggacgcagagaactacgtatatgaaattgtgaaagataacgaaccgtatatcttaaaaattacgcatacgatcagaagaacgccggaatatattctcggagaaatggaatggcttcatcatctggcaaaggaagggctttcagtagcaaagccgattccttcattaaatggcaaagatgtcgaagaagtgccggacggaaaaggcggagcgtttttattaagagtctatgaaaaagcgcccggacgcaaagtggaggaatcagactggaacggaactctgttttaccagcttggaaagtacacggggaacatgcaccggctgacgaaaagctaccgtctgagcgatccggcatataaaaggcaggaatgggatgaagaggagcagctgaagctgagaaaatacgtgcccgcagatcagcatctcgtatttgagcgggcggatgctctaatggaaaaactgcgccgtttgccgaagaatcctgaaaactacggccttgtgcacgccgatctgcatcatggcaattttaattgggacaacggaaaaatcactgcatttgattttgatgatatcggctacaattggtttgtgaatgatatcagtattctgctgtacaacatgttgtggtatccggtcatcccgtatgaagacaaggccgcgtttacgggtgaattcatgactcactttatgaaaggctacagggaagaaaatgaccttgattccgcatggtttgaacacatcccggatttcctccggctgcgccatatgctgatctacggattattgcatcaggcgtttgacctcaattcactcggggacgaggaactcgggatgctgaaagccttcaggcgcgatatcgaaaatgaaacaccgattacggagtatcaattttctgcattcgtataaatagaaaaacgccggctgaatccagcccggcgttttttataacgtatcacattttactccgacgacgccctgaatttctttaatatcataatagacgtcagtggtgtagcggtttttatgaacactgactttcacttccataatcggaaattctttttcacccaggtcatcaatccggacggagtgaatgcggagctgtttgcttttcatttcctttaaaatctcggtcattttgtctttatcggaaagagacattctcacgcggatatccttttccttcaagcgattgggaccgatttttctgatcagccacggaagaaattcgacactgatcaggataaacaagaggcttgcgaacgcctctttataaaagccggcgcctgtagccagacccagcccggccgcgccccagatgatagccgatgtcgtcaggccggatatgacgtcattgcttttacgcaggatcacgcccgcgccgataaaaccgacgccggaaatgatttgggcgggaaggcggagcggatccatcatgatacggtaatatttcgggaaatgatatgctgcattaatgctgacgatcgtcagcatacaggagctgacggcgatgacaatacaggttttcagtccgagcggtttgtttttcagttcgcgttcaagaccgatgatcatgccgatcagcgtggcaatgcccagctttaataaaatgtctggttcgataggccagctcaatttgcacagcacctccgcaatttttcttataataaattgatatgattttctcacagtatttatagcaggacaagtgcggaagaaaaaagccgtcagggataaaatctgacggctttttgtctatttcttgtttttcaaaagagcttccatccggctgaacagctgataagaagcatcggccggttttttggtcagcaggctgacggcaataccggcaatcagactgaggaagaaccccggaatgatttcgtatacgccggttgaagcggcaagccctgtcgtaatccagattaaaacggccgcggccccggtaatcatcgccgcaagcgctccccattcattcatccgtttccagtacagactgagcaagagcgcggggccgatagccgaaccgaagccagcccacgcatatccgaccagatcaagaatggtgctgttcggattcatggaaagcaggatggcgataacggccacgatcaataccgacaggcgtccggtcatgaccaattctttatcgctcgcttcccgtctgaaaaaggcgcggtataaatcttccgtaatggcgcttgccgttacgagaagctgtgaggaaatggaactcatgatcgccgctaaaatcgcggacagcaagaagcccgtaatcagcggatggaacaagattttagaaaaaataatgaaaatcgtttccggatcttttacggagaccccgaagtgatgagaatacgcaaccccgataatcccggtcagcaatgagccgacaactgaaataaacatccagctcatcccgattctgcgggcgggttttaaatctttcacttctttaatcgccataaatcgtacgatgatatgaggctggccgtaatagccgagtccccatgccaaataagaaataatgctaatgacgctcgcgcctttaaagatatccaatagtttcgggttaacggcgttgatcgaatcaatcgtcgttgaaacgctcccgagctgggtaaaagcaacgatcggcacaagcactaatgccgcaaacatgatcgctccctgtacaaagtcagtcagactgacagcgaggaaaccgccaaacagcgtataaagcacaactacacccgccgttaaaaacaaaccgaatttgtagtcggcgccgaatgccgattcaaataacctgcctccggataccatcccggacgatgtgtacagtgtgaaaaagatcataataatcacggcggaaacaattttcagcaatgatgacgagtggcggaatcgtttatcgaaaaaatcgggaatcgtaatcgcatcatccgcaacttccgtgtaagcgcgcagcctcggagcaagcagcagataatttgaatacgcgccgatcgtcaaaccgagcgccagccataaggtcgataaccccgttgcgaacattgcgccgggaactcccatcagcatccatgcgctcatatccgccgcacctgcggacagcgccgttacgaacggaccgagtcctcttccgcccagcatgtaatcattaatattcgttgtctttctgaatgcgtaccagccgattaacagcatggcggcaaagtaaatgccaagagatataattaattcaatactcacgtttttggaccctctcttctttcatgtaaatgttgcatcacctctgtagattagtagtgccggcgatccagcctgcctttagtcatctttcgatggggatcgcatgatttagtgccggctatggttactaaacctaacaaagtatccccgatcaatcaactctcgaaacctggcccgctcaaggaaaaaatccccgccaacctagaacagcttaaagaagaaagcgctaccaataaattataaaagtaaaaattttctgacatataattcgtttctctttctccccgatttaggataaaatagagagggtttcatcatgcctcagaaggcggcgttttgttgctttagagggctcgtttttgatatgatcagtattatatgacgaaacggagaattatgcggaggtggatcttatgtcacgaatttctatagaagaagtaaagcatgtcgctcatttggcgagactcgccattacggatgaagaagctgaaatgttcacagaacagcttgacagcatcatctcgtttgccgaggagcttaatgaagtggacacggataacgtggaaccgacaacacacgtgctgaaaatgaaaaacgtaatgagagaagatgaagcgggtaaaggccttccggtcgaggatgtcatgaaaaatgctcccgatcataaagacggctatgtccgtgtgccatctattctggattaaaggagggagacagtatgtcattatttgatcacaaaatcacagaactgaaacaaatgatacataaaaaagaaatcaagatttccgatcttgttgatgaatcttacaaacggatcgcatccgtggatgataaggtgcaggcgtttttacagcttgatgaagaaagagcccgcgcttacgcgaaagaacttgacgaagcggttgacggacggtctgaacacggtcttctcttcggaatgccgatcggcgtcaaagacaacatcgtgaccaaagggcttcgcacaacatgctcaagcaaaatcctcgaaaacttcgatccgatttacgatgcgacggttgtggaacgccttcaagccgctgaagccgtcacaatcgggaagctgaatatggacgagttcgcgatgggttcttctactgaaaactccgcgtacaaagcgacgaaaaacccttggaatctcgatacggttcccggcggatcaagcggcggttccgcagctgcggttgcagccggagaagtgccgttttcactcggatctgatacgggcggctccatccgtcagccggcttctttctgcggcgtcgtcggattaaagcctacatacggacgcgtgtcacgttacggtttggtcgcttttgcgtcttcacttgaccagatcggaccgatcacaagaaacgtagaagataacgcattcctgcttcaggcgatttcaggcccggacaaaatggactctacgagcgccaatgtcgaagtgccggactttctttcttcattaactggcgatattaaaggcttaaaaatcgccgtgccgaaagaatatctcggagaaggcgtcggcaaagaagcgaaagaatcggttttagccgctttaaaagtgcttgaagacctcggagcgacatgggaagaagtatctctgccgcacagcaaatacgcgcttgcaacgtattatctgctttcttcttccgaagcgtctgcaaaccttgcgcgctttgacggcatccgctacggctaccgctcagacaatgcggacaacctgatcgacctttataaacagacacgctcagaaggcttcggcaacgaagtaaagcgccgcatcatgctcggcaccttcgcgctcagctccggctactatgacgcgtattacaaaaaagcgcaaaaagtgcgcacgcttattaaaaaagattttgaagacgtatttgagaaatacgatgtcatcgtcggaccgacaacgccgacaccggcattcaaaatcggcgaaaaaaccagcgatccgctcacaatgtacgccaacgatattttaacgatccctgtcaacctcgcgggtgtgccgggaatcagcgtgccatgcggatttgcggacggactgccgctcggactgcaaatcatcggaaaacacttcgatgagagcactgtataccgcgtcgctcatgcttttgagcaggcaacagatcatcataaagcgaaacctgaactgtaaggggtgaaatgaagtgaactttgaaacggtaatcggacttgaagtccatgtggaattaaaaacaaaatctaaaattttctcaagctcaccgacgccattcggcgcggaagcgaatacccaaacaagcgtcatcgacctcggctatcccggcgtgctgcccgttttgaacaaagaagcggtcgaattcgcgatgaaagccgcaatggctttgaactgtgaaatcgcaacggatacgaagtttgaccgaaaaaactatttctacccggacaacccgaaggcatatcaaatatctcaatttgacaagccgatcggcgaaaacggctggattgaaatcgaagtcggcggaaaaacgaaaaaaatcggcattacccgtcttcaccttgaagaagatgcgggaaaactgacgcatacgggcgacggctattccctcgttgacttcaaccgccagggcacgccgcttgtcgagattgtatctgagccggatatccgcacacctgaggaagcttacgcatatctcgaaaagctgaaatcaattatccaatacacaggtgtttccgactgtaaaatggaagaaggttcactgcgctgtgacgccaacatttccctccgtccgatcggccaggagaaattcggcacaaaaacggagctgaaaaacctgaattccttcgcgttcgtgcaaaaaggacttgagcatgaagagaaacgccaagagcaggtgcttctgtcaggcggagtcattcagcaggagacgcgccgctacgatgaagcgacgaaaaaaaccattttgatgcgtgtcaaagaaggttcggacgactatcgttatttccctgagcctgaccttgtcgagctctacattgatgacgaatggaaagaacgcgtaagagcaaccattcctgagcttccggacgagcgccgcaagcgttatatcgaagagctcggtctgccggcctatgacgcaatggttctgacgctgacgaaagaaatggctgatttcttcgaagaaacggtcaataaaggcgcggaagccaagcaggcatcaaactggctgatgggtgaagtgtcagcttacctgaatgccgaacaaaaagagcttgaggatgtcgcactgactcctgaaggccttgccggcatgattaagctgattgaaaaaggaaccatctcgtccaaaatcgcgaagaaagtctttaaagaattaattgaaaaaggcggcgacgcagaaaaaatcgttaaagaaaaaggcctcgtgcagatttctgacgaaagcgtgcttctgaagctggtaacagatgcgcttgacagcaacccgcagtcaattgaagacttcaaaaacggaaaagaccgcgcgatcggcttccttgtcgggcagattatgaaagcctcaaaaggacaggccaacccgccgatggtcaacaagatcttacttgaagaaatcaaaaaacgataaaaaaagcagccgcctctaagggcgctgctgacacggagaccggtaagcgccggtctcttttttataagctgaaataggtttcaatggaagcccgcagcgtttcaatctgctcatttccgctgcctgccaagttggacagcattcctttaataatcggttttcgcggctcttcctttgcgtattcctcttcaatgacttcaagcgatacgaggacgtcctcaggcagcccctgctgtgcttttatcttttgaatatccgcaagcagtctttctctgtccgccgccggctgagtgaagatatcctgcggcagcagcggatcgggattgtctcttatcagtcccgtaatcaggtcatcgattctggcaatcagaaaggccgccacgttttccgtccggaatgccgtatgttcattaaaaatcaagaaatgaatataggagctcactattccttgcgccataacggacgcatccgctataaacggtatgacggcatctctgtaaacggagagcaaagcatcccggtacagtatgttaaattgaatattggcctcatgaaaatactgtttgaccttttgattttcaggaatgaccttttcgctcagcaagagaatgataaagtccttgtgctccataaattcctggaattgataagcgatttgttttcggaatacgtccttaggcgatttatgctgatgttctgttttgattttctttatttcttccatagacatgccgatgtaatactcacatgctgagagcaaaaggtcttcttttgatttaaaatgaagatagaaggccccttttgaaattccgcattcaccggcgatttcctgaatggttgttgaagaaaacccttttttggcaaataaatggatgcctgtttttatgattttctcttttttttcgttcatgacgtgcttccccttaatcctgaaaaatttagaaaaatttactgccttattagttgacgatgttgagttataccgtttagtattatatagaatgaccagtcagtcaataaaaattaacggaggacatgatgaaccacattattaactttgtactgaagaacaaattcgcagtttggctgatgacgattatcgttactgtagcagggctgtatgccggtctgaatatgaagcaggaatccataccggacgtcaacatgccttacctctcagtaaatacgacttatcccggagctgctccgagtcaagttgcggatgacgtgacaaaaccgatcgagcaggcggtgcagaatttagaaggagtgagcgtcgtaacgtccacatcctctgaaaacgtctcatcggttatgattgaatatgattacaacaaggatatggacaaggcgaaaaccgaagtcgctgaagcgctggacagtgtcagccttcctgatgacgcgaaaaaacctgacatttcccgttacagtctcaactctttcccgattttgacgctcagtgtgacaagcggcaaaagctcgcttgaagatctgactaaaaatgtggaaaacactctcgttcctaagcttgaaggcattcagggcgttgcgtccgtacaagtttccggacagcaggaagagcaggtggaattctctttcaaagataaaaaaatgaaagagtacggacttgatgaagataccgtcaagaaagtgatccaaggctctgacgtcaatacgccgcttggattgtacacattcggcaacaaagaaaaatcagttgtcgttaacggaaatattacgtcaattaaagatctgaaagagatgagaattccggtcacatcttcttctgccgctcaaggtcaagcgggcggagccggtgcggcatctgcggcggacgctcaggctatgcagcaggcacagcaaagcgcgtcagcaggggtgccgacagtcaagctctctgacattgccgacattaaagatgtgaaaaaagctgaatccatttcccgcacgaacggaaaggacagcatcggaattaatatcgtaaaagccaatgacgccaacacggtagaagtggccgatgcgattaaagatgaactgaatcaatacaaaaaagaccataaagggttcaagtacagctcgactcttgatatggcagagccgattacagagtcagtggatacgatgttaagcaaagcgattttcggcgcgatttttgcggtcgtgatcattctcttattcttaagagatattaaatcaacgatgatttctatcgtttccatcccgctgtcactgctgattgcacttcttgtgctgaatcagcttgatgtcacattgaacataatgacgctcggtgcgatgacggtcgccatcggacgggtagtcgacgactcgattgtcgtgatcgaaaacatttaccgccgcatgaggctgaaagatgaacctttacgcgggaagcaattggtgcgtgaagcgacaaaagaaatgtttaaaccgatcatgtcatcaacgatcgtaaccattgccgtattcctgccgcttgccatggtcggcggacagatcggcgaactgtttatgccgtttgccttaacaatcgtcttcgcgcttgccgcatcactgttgatttcgatcacactggtgccgatgcttgcgcacagcttattcaaaaaatcgctcacaggcgcacctgttaaagcgaaagagcataagccgggcagattggccaatttctataaaaaagtgctgaattggtcattaagccataaatggattacatctatcatcgcggttctgatgcttgtcggcagtttgttcctcgtacctctgatcggcgcgagctacctgcctgcgcaagcggacaaaacgatgcagctcacatacacgcctgaaccgggcgaaacgaaaagcgaagctgaaaaagctgcgcaaaaagcggaagatatgctgcttaaacgcaaacatgtcgatactgttcagtattctttaggatcgcaaagtccgctcggcggaagctcaaacggcgcattgttctacgtgaaatacgaggatgacacgcctgattttgacaaagaaaaagacaatgtcttaaaagaaatcaaaaaaacatcgagccgcggcgaatggaaatcacaaaatttcagttcgtcaggcaacaacaacgaattaacgtactatgtgtacggagattcagagtctgatattaaaggcacggtcaaagacatcgaaggcatcatgaaaaaggagaaggatctgaaagacgtcaactcaggcctttccagcacatatgatgagtacacgttcgtcgctgaccaggagaaactcagcaagcagggcctgacggcttcgcaaatctcccaagccctgatgtcccaaacgtcacagtctcctttgacaacggtgaaaaaagacggcaaagagcttgacgtcaacatcaaaacagaaaaagaccagtataagagtgtaaaagaattagaggataaaaccatcacatcacctgcaggccaagaagtgaaaatcggcgatgtggcgaaagtgaaaaacggcacgacatccgataccatttccaaacgcgacggcaaagtgtacgctgacgtaacggcaaccgtcacttctgacaacgtcacgaaggtgtcatcagccgttcaaaagaaagttgacaaactggataagccggacaatgtatcgattgataccggcggtgtatcagcggatattgcagattcctttacgaaactcgggttagcgatgcttgccgcaatcgccatcgtatacctcgttcttgtgatcacgttcggcggagcattagcgccgtttgcgattctgttctcgcttccgtttacagtcatcggcgcattagtcggactgtatgtatccggagagacggtcagtctgaatgccatgatcggtatgctgatgctgatcggaatcgtcgtcacaaacgcgattgtcttaattgaccgcgtcatccataaagaagcggaaggcctatcgacgagagaagcgctcctggaagccggctctacgagattgcgtccgattctgatgacggcgatcgcgacaatcggcgccctgcttccattggcattgggctttgaaggcggaagccaggtcatttctaaaggactcggtgtcaccgttatcggcggtttaatcagttcgactctgctgactcttctgattgtgccgatcgtatatgaagtattagcgaaattccgtaagaaaaaacctggaacggaagaagagtaagacagcgggccttggctccttaaacggagccggggccttttttcttctggcaattcctgtacatattgttgcgattttctcaagtcatagtataattaaaggttgttagtgttaataatggatcggatactcttaagtaggatgatgagataatgaaacgtgcacgcataatatacaatccgacttcaggacgggagcttttcaagaaaaatcttgcccaggtcctgcaaaaatttgaacaagccggttatgaaacctccacccatgccaccacatgcgcgggggatgccacccacgccgcaacagaagccgctttgcgggagtttgacctgattgtcgcagccggcggagacggaacgattaatgaagtcgtcaacggtcttgcgccgttagacaaacgcccgacactcggcatcattccggtcggcacgacaaatgatttcgccagagcgctgggcattccgagagagaatatactgaatgccgctgataccgtcattaacggcgtggcccgcccgatcgacatcggacaggtgaatggtcagtattttatcaacatcgccggcggaggccgtctgacggagctgacgtacgatgtgccaagcaaactgaaaacgatgctcggccagcttgcttattatttaaagggaatggaaatgttgccttcacttcgaccgacagaagtcgagattgaatatgacggcaagctgtttcaaggcgaaattatgctgtttttagtgacgctgaccaactcggtcggcggattcgagaagctggcccctgattccagcctgaatgacggcatgtttgatttaattattttgaaaaaagccaatctcgcggagtttatcagagtcgcgagcatggcgctcagaggcgatcatattaacgatcagcacattatttacacaaaagcgaaccgtgtgaaagtcaatgtatcagaaaagatgcagctgaacctggacggcgaatacggcggcatgctgccgggcgaattcgtgaatctgtaccggcatattcacgtcatcatgccgaaggagaaagcggaacagctggatgactaatacgcggacaaaatcctaaaacagtattcgttttaggattttgtcatcttttcagcgtgatcggaaacctttgaaggctgacattgaatttgaaggtttgccagcacgctgaaacaaggcttttggtaaaacgagaggtgattatagatgaaaatgaaacccccgatagaaaaaaatgaatactatgacgtgacatttgaggatttgacgcatgaaggagcgggcgtcgcaaaggttcagggcttcccgatcttcgtgccgaacgccctgcctgaggaaaaagcgcaaattaaagtgacacgcgtcaaaaaaggcttcgctttcggccgtttgatcgagctgaaggaagaaagcccgcacagaacggatgccccgtgcccgatctacaagcaatgcggcggctgccagcttcagcacatgacctatgaaggccagctcttgtttaaacagaaacaagtcaaagacgtcttagaacggatcggcaagctggacctctcaaacgtcaccgtgcacccgacgctcggcatggaagacccgtggaactacagaaacaaagcgcaggtgccggtaggagaaagagaaggcggactcgtcgccggattctatcagcaaagaagccatgacatcatcgacatgagcgcctgcctgattcagcaatccaaaaacgatgaagccgtccaagccgtcaaagacatctgtgcagcatacggtgtcaaagcctataacgaagaacgccacaaaggctggcttcgccacatcatggtcagatacggcgtcgtcacgggcgaaatgatgatcgtcttcatcacaagaacaagcgattttccgcacaaagcgaagatcatcaaagacattacggcgcaattcccgcacgtcaaatcgatcgtgcaaaacatcaacccaaataaaacaaacgtcatttttggggacgaaacaaacgtcatctggggcgaagaatacatctacgacctcatcggagacgtcaaattcgccatctccgccagatcgttctatcaggtcaacccggaacagacaaaagtgctctacgacaaagcgcttgagtacgcagagctgcaaggagaagaaaccgtcatcgacgcctactgcggcatcggtaccatttctctatttctggcgaagcaggcgaaaaaagtgtacggcgtcgaaatcgtgccggaagccatcgaggatgcgaaacgcaacgctgagctgaacggcatcacaaacgcggaattcgcagtcggagaagcggaaaccgtcattccgaaatggtatgaagaaggcatcacggccgatacgctcgtcgtcgacccgccaagaaaaggctgcgacgaagccctcctgcggacaatcatcgacatgaaaccgaagcgggtggtgtatgtgtcctgcaatccaggcacgcttgcaagagacctgcgggtgcttgaggatggcgggtatcagacgctcgaagtgcagccggtggatatgttcccgcatacgaatcatgtggagtgtgtggcaaagctagtattgaaataaagcagtgttctcttttggagaacgctgctttttatattaatatgtgaaggatcctttttaattattaagtacaaaggtcatattaaaacagattaatttgaagaaaaatggtattctcaatatagctcaatttagttattttgagcggcgaatttatagagataacgcaaaaagttaatgaaaaggtgaaacaatgatagtctatgaagctacaaaagaagagtttctgagtgatgtgtttgacgacaatttggtgacgaatatctgtaaaaactataatgataagattggcaaaatcaatgagaaagaggttagatcttgggataactctatgcagtatatgtatagggtattaagtgatagagaaattcctaaggacgcaggaattgctattgagttcaaaataccccatacttcaaagcgtattgattttcttatatctggatcagataaggatgatcgttcatctgttgtgattgtggaacttaaacaatgggagaaagtagagaaaattgatagtaaagaggccatcgttaaaacgtttataaataaaggaattcgcgaaacaacccacccatcctatcaagcctggtcatacgcttcgttaataaaggattacaatgaaaatgcgcaaaaagaagatatcaagctatatccttgtgcatacttacataactacttgaatcagggtacagacgatccattaactgattcaatatatgaatattatataaaagaagctcctgtttttatcaaaggtgattcaggtaagcttcgtgatttcattaaaaagtatattaagtatggagacaacaaagaaatcctatatacaatagataaaggaagaataaggccttcaaagtctcttcaagattcgttaaacagtatgcttcaaggtaatcgagaatttatgatgattgataatcaaaaagttgtgtatgagacggctttacatttggcgaatgaggcattacgtacaaacactaaaaaagtattaattgtagaaggcggaccaggtacaggaaaatctgttcttgctataaatttattagtagaagcaacaaaccgaagtcttgtggcacaatatgtaacaaaaaatgcagctcccagaaatatatatgctactaagttaaaacaaaactttcggaaagggcacattgataatttatttaaaggatcgggcagttatgtcaatgctccatcaggtgaatttgacgttttaattgttgatgaggcgcatcgattaaatgagaaatccggtttatttaataaccttggggaaaatcaaattaaggaaataataaatgcttccaaactttctgtttttttcatagacgaacatcaaagagtaacattaaaagatattggtagcactgatacaatccttaaattctcaaaagaattagatgctcaggttacaaatatgaaactggattcacagtttcgttgcaatggttcagatggttatataagctggttagatgatgttcttcaaattcgggaaactgcgaattctaattatattggaatgaactacgattttcgtatatatagaaatccaaatgaattgcgtaaacagatagaagatctgaataaagttaataataaagctcgaatagttgctggttactgttgggattgggtgaaggaaggcaaagctaaaacagaatttcatgatatcgagattcctgaatatcaattcggaatgagttggaatttaaataactcagacacgtgggcaattgatgaagattctattaatgaaataggttgtatacacacatgccaaggtttggaatttgattatgtaggtgtaattataggaaatgatctagtgtgcagggacggagtagtattgactgatcattcaaagcgggcgaaaacagatacctccttacgtggtttgaagaaaatgctaaagcaaaattcagaagaagctgagaagcttgcagacgaaattattcgcaacacatacagaactttgatgacccggggacaaaaaggctgttttatttattgtatagacaaacaattagaaaattacttttttaaaaggctgaaacatatgcaaatgaattacaaagagaatgagttctttaagtcttcatcagttgctgaagaaaaagccacatataagcacaaatgaaaccttttttaattatttattaaaacggaattgggaaaaaatcacgctatgatcttgtacctttaaaaagcagggaggcaagattttgcgacaactgttaaaggctttttaacgaatgcgactaggatttctaccgttgttgcaggaaaagaaaaatctatttgtgtaggagatccttacaaagcttcttaacaaagtggcgattgttaatgacttggggaatgaaagcataatattaacgtaaagcgataaaaggcttcttttaagaagcctttttatgtacgtatatcttcataatcaagataattatttataaaaagataataaatttggataaaaatgagaaaatcctggcgggaatgacgatataaagttagtgaacaacggtatagaatcttatttttcgaggtgaacagaatgggagaagaacaagacattattacagtaaccgatctgcgcaaaaaatatggatcatttgaagcagtgaaaggggtatccttttctgtcaaacgcggcgagctgtttgcatttctgggaacgaacggtgcagggaaatcgaccactatcgatattctctgtacgctgattaaaaagacatccggaaaagtggtaatagatggttatactcttggtgaggggaaagagaataatcatatccgcaaaaagatcggagttgttttccaagagagcattttggatgaacgattgaccgtttatgaaaatatcatgaaccgcggacaatattatcatttaagcaaggcacaagtgcaagagaactatcagtttgtaacagactatttaaaattggatgatattaaggagaaaaaatacagcgatttgtcaggaggacaaagaagaagagcggatattgcccgtgccatcatccataaaccgactatattatttttagatgagcctactacaggtcttgatccgcaaacgagagtatttgtttggaatgcgattaaaaggctgcaggaagaaacaaacatgacgatctttttaacgacccattacatggaggaggccgctgtggctgataacgttgtggtcatcaaagaaggacgcctgatcgcagagggtacaccgagtcagctcaaagatcaatatgcgtttgacagtctgcatatgatgtttaagcaaggcgttgatccgacggcatggtttgaaaataaacaactggattttacggttaaaaactctatttattcccttcgtgtagagtccactctccaagcgtttgacattttgaaaggtcttgaaggaaaaattgaatctttcgaagtgattaaaggaaatatggatgatgtgtttatccatattatcgaagaacaaggaagcagtttgccagtaaaggggagcattgcataaatgaagtctttatccagtttaatcagcagaaatataaaaatatacttccgtgatcgaacgcttttgcttctctctttgctgtcagtatttatcgtcattctgttatatgccgtgttcttacagcagacacagctggacgccattaaggccctggtcggttcgacagatgattccaaagcaatggtgaacgaatggatggtggcgggattgctgtccattacagctgtgacaacgactttaggcgctttcggaattatggtgaaagataaagaaagcaagagaacgtatgactttttaacagctcctttatcaagggcgaccatccaattgagctatgtcattcattcatttgtcatcggcttgatcttttctttcatcgcctttttaggctgtgaaatttttctcgtttcaacaggcagcaagcttttaagcggtacagatatacttgaagtattggggatcattattctttcagttgcactctcgagttccataaatttatttttaacgctgtttattcacacacaaaatgcattttcgacgttaagtacgattgtcggaacagccatcggttttttatgcggagtatatgtaccgatcggcggcgtaccggtgtttgtgcagaagattattatgtatttccctatcagccacaccgccgttctgttcagaaaagcgtttatgacagactcagttgataaagtgtttaaacatgcttctgcggaccaaatacaggaatatgaaaagcattacgggatcgtctacaagttaaacggccattttatcagtacggctgcgagcttgtgggtcattgtcattacagccatcatatttaccgtcatatctattttcatatttaaaaaacaaaataaatgacttcttcagacgatacataacgatgtaacaggcagcatccgtttactggatgctgcctgttttgtttatcattattctttttgtgctcaattcttaattcctcaaaaagttctcggatttctcttgaaaagtgttgaagatatctttatttacactgtatcaggctggtagatcttgcgaataaatcagttgacgtttttttggtgtcttgaagtgaaagagaaccatgggagagtcatctaatacttctgcataaagatatatttttgcccattcataaggtatgatgtagttataaaaaatagcccagcaaggaagtgctgagccattattgacttatagaccgacgtagtttattacaaattctttatcgtcctcatcttcaggcaaaatccccaagttttgatattcccataccacttgccgttgtgttccgtttaagtctgaggcgatgacatcggtgtaatcgtagtcaattgagaagaatttaccgcttcgttcgagatgcaaagtgaggtttgtccataagtcctcgttgtttgttttaaattgatcccgtaactcttcaaagtaatcttgcaattcatatagaagttcgtcatatatatcttcatcaacattaaaatgttcaggaatatcgtgtgaatatatatattcctgattttgtggagtactaaagaagaagtaaacttctgaagaatcatctaaaatttcggcataaagagcaaccttctcccactcagaggggataatttcatttatttgctcagcgattttttgatatagttcgcccattttttcagtttccacaatatcagaatcctttttaattttttttagccgtttgaaagcttattatatgtttagatactcttctatgaattttctatcgtcctcatctttaggcaaaatccctaaattttgatatttccaaacatctcgtctttgaaggtcatcaagttcagacaataaaacatcctcatcgttataatcaattgaaaactttccggtgttttctaattttaaagtgagattagtccaaatatcttggttgcctagtttaaattcttcttttagttcttcaaatagctcttgaagttcaatcagcagttgatcgtaaatctcttcgcttactttaaattgttcaggtatataatgagaatataagtaatcaccattagttggtgttgtaaaataaaagtatatatccgctgagtcatcaagtatttcagcatataaaacgatcttttcccattgagatggaatcatttcatttagatgttcagcaatcttttgatatagttgttccattttttcagctaccattgatgatcctctacctttgttgatagcattatttaatatttagataatccttaacaaattctttgtcctcttcgtcttcagggaaaatccccaagttattgaactcccaaatcatttgtctttcgtattcgtccaaatcagattcaataacatcttcataatcataatcaattgagaacgttccatcgctttcaagattcagtgtcaaatttgtccatgctttagggttattttctttaaattcagtgtgtaactgcataaacaactcttggaggtctagtagtagtccggtataaatttttttactgacctgaaattgttctggtatgtcatgagagtatatatattcatcgttttcgggtgtttgaaagaaaaaataaacttctctggaaccgtctagtatttctgcatacagaacaactttgctccattcagaaggaattatttttcctaagacatcagttatttttagataagctttttctaacatcattatcccaactttattaaattggattttcaggatattcatctaaatattttttattaatttttgtaatgatggatccttaggttcttcccttaagtatttgaatttccagatgataagctgatcactgaaactataatctgtcttaaaccaatctgtataatcaaagttgacagttaattttccggatctttctaggctaagagtgaaagaataaaataattcttgatcatgatctttgaaaacatctctcattttttcgcttagtttaaataattccatctcatactgatcgaattcattttcgtcaatatcaaattcaaacggaatttcaagactgtacttaaaataattaggttcattttgagaattgtaaaaaaagtaagtgcctccgcctgtctctgaatctgagcatagaacaaaaatttctcccatggttctggtatcatttcgttaacgatttcagctatgtttctatataatgcatttaattcattttccaacaaggatcagcctccagcattataattggtaatttgtaaggatcatttgtatcaaaaaaacccccaataaaggagggggaattttaattttgagaatttaaatactgttctaaaaaggattttaaaggtttactcttaggataaattcctacatttttataagtccagattgtttgtctttgagagatggtatatggagattgaataacgtcttcataattatagtctatcgaaaattctccgcttatccccagattaagtgttagattagtccatatatcttgattgttttctttaaattcatctcgtaattcctcgaataagtcatgcaagtcaaataacagctcctcataaatctcctcactgacatgatagtgttcagggatattatgagaatatataaaatcttcactatgtggagtattgaaataaaagaaaacttcagatgaatcgtcaagtatttctgcataaagaataactctttcccattcagatggaatgatctcattaatgctttctgctatcttttgatataattgccccattttttttgtctccatattaacctccggcctgatttttgattctcataagtttagcttcttgatcaccaattttatatttcaccctaaaagcagtaggtcttaatgaatcacctttatacaatgcattaatttcaactgatactttttggggagggtctgcttgcaaagccgatgcccaatcttgctccattttgtaccatttcccgccgctcctattaatctgagaattcatcggcacgatgttgtcgaattggcctgagcctttgaattgggtggcgattaggtggcctccgtcgtcatctgtcagacggtctggtttacctgcttttgattgcgcatattggttgcgttttgcttctcccagctgcaagtctgctttgacacttgtaattctaccatagttgtcagtggtgtacgtgtagccttcttttgttttatagatgacattcggcttcaatactttctttctggtccatttcgcaaaatgctcgccgtatttgaccgttaccggcggtacatgcggtgccggtgtccgtctgccgcttgcggaggttccgtacggtttcggcaggatgaccttggcgaatttctgaagtccttctttaagtgtgaccccgttgactgcgttgtaaggaacgcccgccggcactacgtcgtgacgcggatgatacgggagaatatcagccagggtgagatctccgatttgatgtaacttggttttgacacgtttttttgatacttctatgcctgtgtttactttttgtttgatgtgatcaacggtttgttttgagaccgttatcgctttttgtgctgcggcggatttgcgtgctgctgttttgactttggttgtcactttggcggctgttcctgtttttgagacggcgccgacgccttttgtgccgacaactgatgtcacaacggtgcccactgcatatgacacccatcttgctcttgagtaggtgtcgccattcaccatgtctttttggtacgattcttcgattgccgctgaaatggcttcatacgtcttgatcgggtgagccgccgctcctgtaatggcttcaaccgttccgcccggatctgtgacaatatcccacaggcctgtgaccgcgtcttttccggaatcataaaggccgacggcaacgcctttgaaaccgtctgtaagttcacgcgtgttttcaatttgagtgaagtagcgctgctgttcttttgtcaggtttttatagccgattgttttggccattgagtagaattcatcagcattcgcataatcgtagtttttcagtctttctttcagtttttcaatctctcgttccttcgcttcctctttcttcatcttcaaataagcatccgaatgtcttgcaatctcgccttttttcttatggatgtcgctttcacggtacgccttggcgttgtagtgaagcggcgtggcgctttttcctttgcccgtggcattttgaagctgctggaagtcagcttggatgaactgttcgttcgcttcggtttctgcgtattctttcgttagatcgtgatcaagcttgccgagcttatgtatcgtttcgcttctttttttgtcagctgaagaaagcttctgatctgtgctttccgttgaaaacagatcaagcgagatgatgtcatcgatctcaccgaggatggagcgcatgtcctttttctgctcttccataatcgcctttgatttactgagggcgtgggtgagctcatgctccagaaatgattcctccacatgcgaattggaaagtccggcatcttcgaccttaccgggaaggcttgtgagaaatgcgattttcatgtcgatcagatcaagccagctgtctgtgacgccggcgtggtcctggaaaaaggctttgatgttatctgcgccccgaccagagaaatcgccgtcaccgagatcagccacgccttgaaatgcttttttcagattaaccatctgaccgcgcagttttttgtattcacccgcgcgctgtttggcagcggccagcagggtggttgcttcgaaaactttcatgaccatatcctttcttttgttcgatatcaaaattttaccacgggagtcaggatatacagtgtaggaaataggtaataagaataaaatgaatcttttgacttgcgacttccttcctgtatgaagggaggcttttttatgttttgtacaataatcctcaaattcggcttactgcgctccggtgattttaagcgtgcctgttttttctaatgtcttacactcgaaacaacccaaccgctgaggtataatagaagcagagtatttatcatacagattcaattcgtgaaagagagtggaacaaaatgggccgtaagtggaacaatatcaaagaaaagaaagcatcaaaggacgcaaatacgagccggatttacgcgaagttcggccgtgagatttatgtggcggcaaaacaaggcgagccagatccggaatcgaaccaggcgttaaaagtggtgcttgagcgcgcgaagacgtacagtgtgccgaaaaatattattgagcgtgcgattgaaaaggcgaaaggcggcgcggaggagaactttgacgagctgcgttacgaaggtttcgggccgaacggttcaatgatcatcgttgatgcgttaacgaataatgtaaaccgcacggcgcctgaagtgcgcgccgcattcgggaaaaacggcggaaatatgggtgtgagcgggtctgtcgcttacatgtttgatgcgaccgccgttatcggcgttgaaggcaagacggcggatgaagcgctggaattgctgatggaagctgatgtggacgtgcgcgatattttagaagaggatgacagtgttatcgtgtatgctgagcctgatcaattccatgccgtgcaggaggcattcaaaaatgccggcgttgaagagttcacggttgcggagctgacgatgcttgcgcaaaatgaagtcgagcttccggaagatgcgaaagctcaattcgaaaagctgatcgatgtgctggaagacctcgaagacgtacagcaggtttatcacaatgtagatttaggcgaataaagacaaaaaggccggggcggcataagttccggcctttttattttgcttatgcggccggcctgtatcgtatttctccgtaagcaattattgattatttcgccaaaactgggcggatgcccatacgtttccttccgcatgtcataaactggactgtaacctatgtgaaggagcgataaatcatgaatgaaagaagaccgatttacggcggaggctatggcggctacggaggctacccggggtacggttttggcggctacggtggctacggcggcttcggaggatatccgggatacggtttcggcggaggctacggctacccggggtacggttttggcggttacggcggttacggcggttacggcggttacggcggttttggcggctacggcggcttcggaggatatccggggtacggttttggcggctatggcggaggctacggcggctacccgttccatcaccatcatcatcgggacagccaatatatctgaccattcgggaaaagcactcttggaacagcaagagtgctcttctcatgttcttgcagctgtggtacgattggagcaaaatcatcaagtacatatgacatttctgtaaatcatgagcaagttgtttataaactgaaaagcatgatctgtaaaaatctctttatcgggaggttttacatgtgagaagtgaagacgaaatgatgaaattgattcttgatattgcgatgaaggacgagagaatccgtcttgtcactttagagggatcaagaaccaataaaaatgtaccgcgagacaaatttcaagactatgatatttcttattttgtgaccgatatggactcttttatatctgatgaaagctggctggatcagtttggcgaaagaatgatgatgcaaaaacctgaagatatggaacttttccctccggaactcggagactggttctcctatctcatgctttttaaagatcatcataaaatcgacttaactttgatccctctgagtcaaacagaggattattttacacagagtgatggtttggcggaaatattattagacaaggatgaccgaatcaacagtaagatgattgcgagtgatgaacaatatcatataaagaaaccgacccccggagagtttgatgattgctgcaatgaattttggatggtttcaacctatgtgattaaaggattaatgcgcaaagaaatactgtttgcgctggaccatatgaatgacattttaaggcctaatgttttgcgtatgattgcgtggaatattgggatagagcatcagttttcattaagtgtagggaagaattataagtatattcaacattacatgaatgcgaaagattgggaaattctgctgaatacttatgtcggcaatacttatgaaagcgtgtggaaggcattgtttgactgccaaggtctcttcagagcatattcaaagtcagtggctgttttattgagatacgaatatcctgaatatgatcagcaaattacggaatatacattgaaacattatcagtgctttcaatcagatttttcattatgatttttttacttcaaattccagatgagctgcatggagtccgtttttaacgggcttttttattttcttacagggcataaatgctgatacggattcatacctattaaggtcatgtgtttaggaaaggaggatcgtaatgaaagaaaatcagccgtttacaccggtcaaatcctataaacccttccacagccggtttgatccctgcccgccgatcgggagaaaatactacagaacgccgccgcatctttatatgcggtttcagccttatcacttggagcagttttctccgatggaggcattaagaaaagggaccctttggaaggatctttacgatttctatgataatccttatcgggggggaatcgaatatggcgaaaaagattgatgatgaatactatcggctgctggagcaaattcaggcggcggactttgtcttggtggagctgacgctttatctggatacgcatccccatgaccgtctcgcgcttcagcagtttcatgaatattcccggtactcaaggcagctgagaaaacggtttgagcctgagtacggaccgcttctgcaattcggcgtgagtcaggccggcgctcaatgggactggggccgcggtccttggccatggcaagtataaggagggatctgtaaatgtgggtatatgaaaaaaagctgcagtatccggttaaagtgagtacgtgcaacccgatgctggctaagtttctcattgaacaatacggcggggcggacggcgaattggccgcagcgctccggtacttaaaccagcgctacacgattcctgacaaggtgatcggcctgctgacggatatcggcacggaggagtttgcgcatttagaaatgattgcgacgatgatttataagctgacaaaagatgcgacaccggagcagctgcgtgatgcagggctcagtgatcattacgtcaaccatgacagcgcgctgttttatcacaatgcggccggcgttccgttcacagcgtcttacatacaggcgaagggagatccgattgctgatttatatgaggatattgcggctgaagaaaaggcgagagcgacgtatcaatggattattgatatttccgatgatcctgacctgaatgattcactccgttttctgcgtgagcgtgaaatcgttcactctatgcgtttcagggaagcggttgagattttaaaagaagaacgtgataagaagaaaattttttaaacggccctcaaacatgacggctgtttttttcctttctgcgtttggtctataataaaggtgtcgaatattctgattacaggaggattttatgacaccatttacgattacggaggagaaggcgggggcattccgggtcacctccgcccggaaggatgatgaagaagaagtcatggatctgctcgtgcaggcggcagaatggcttcgcgataaagggtcgaaccagtggagcggccttctgcaaggggaagatacccacaatatgcgggaggcgatcgccaaagggtatgtttttttattcaggcagaatgaagagctggccggcgtcgtcatgctgcttcccgaagcaagcgggtgggacagacgtctatggggcgatgaaggacatgaggagtccgtatatctccaccggctggcgattaacaggcggtttgcaggggcggggctcggccggacgatcatgacttgggcggagacgggggtgtcttgtcctggaaaaacgaaaatccggctcgactgcgtgtccggaaacaaggcgcttcagtcgttttacagcggaatgggttacgaatcaaaaggactcgcgccgggttatcatttgtttgaaaaaaaggtgagcaaataaaaagctcctcatgacggaggtgcaaaagacatggggtttttttatctgatctgtctggccgcattttgtcttaactttgccgtatcggctgtgctccgtaagaaatggccgaaaaagatgtggcctgagtggcttttggcggtgctgggcctgactgctttcggtacggttgtttacagcattttcggtgtcggcggctgggaaggcatgggcttggggcttgccgcgatgtttacgggttccggagcggccgccggttatgccgctgaggtatgcttacgggtcgtcagatcgaatcaaaaacagtaagcagaagtgaaaaaacgcagcctcgtctgcgtttttttgtgtattgccggccgctgtatagaaaacaggcgaatgtccataatggtaatgacttttaagaagaaggtgcgaatatgggacatttacttacagtggcttgggagttagtatgcggcttgggtattttatttgtgattttaaaattgcttggaaaaactcaattctcacaaattacgccgtttgattttatttccgcgctcatcctcggcgaactggtcggaaatgcggtgtatgataaaggcgtcaggattattgaaatcatttttgcttctctgttatggggggttttaatttatctcatcgaactgattacgcagaaagtaaaaagctccagaaagctgttggagggcgagccgagtattatcatacataaaggaaaactgaaatatgatgtgctgaaaaagaataagctggacattaatcaattgcaaagccttctcagacaggcgaattgcttttctatacaggaagcggagtacgcaattttagaaacaaacgggatggtcagcgtcctgccgaaatttcaatatgacacgacgaaaaacggcgacatgcaaataaagccgaagcaagtctctttgccggtcacgctgattattgacggcgaagtgctgtatgaaaatctgaaagaagccgggctggaagaaaagcagctgaatcaggagctgaaaaagctgaacatcaaaaaaacggaggacgtgctgtatgcggaatggaagcccgataaaccgctgtttgtcctgccgtttgaggagaaaaaataaaaagagcattgccctggggcaaatgctctttattatttttcgtgtacgcctgttttaacggctctgacatgatacataccgacatccgtcccaagcatataatcaggtttcggcttgccttggtttgctttgtgggccgcgatgtggtcttcgcttttttcccattgtttccaatggtcttctgactcccagcggattaacacgacgacttcttcatcaccgcggcggacttttttttccaggaccgttacgtctatcaaaccttcctgcttttcaatcacgccttctgaactgaagcgttcgattactttgtcggcatgtccttcttttacggtcatgtttctgatttgcacaaacatctggcagctctccaatcctttttacgttttatccaacattttaaatgaaaatgattctcaaagtcaattaagatgcctgacggattacgatttcaggagaaagacatgaccatcctcatctttaaattgcacgaagctgccccattccatttgtttcggttcatctaaaaaggtgatgccgttccttttcatctgttcatatgcggcaaagacatcttcacactcaaatacgatagaagccttcatatgctcggcgcctttcatcatcgatttcggataaataaccaaatgagtggcggcccctttgggcgctacctcaagccagaaggcgcccggtcccatcggatgctcggcgacggtttcaaaccccgctttttccgtccagaatgttttcgctttttgctgatcatcagtgtatacggcgactgtcgcgatttttttgatcatcatactgacctcctgtttcatttcttttatagtgtatcctcctgccgaaaaaagcaatcaaaagcttaatgtgcaggtttttttaatttctctagtgcgatcggtgattccgatttataatttagacaaaagtacatattcttgaaagaggagacggcagtgaacaaagaccaattacttcatgattatattattacacattcggcagagctgacggaaaaatggctcaagctgagacggaagctgagagggcgtttttattctgcggatcaattaagtgaggaaatgaaacggctgctgatcgagcagcatacctttacaaacacggtcatcgcaagcgcttttttggaagatccggccgtttttcagcataacaaagaaaaatgggccgctcaggtagcgaaaagcagagtggagcaagacgcggaggttcatgaggtcgttgaggcgatcggcaattcaagaaccgtcttttgggaggcggtcacccgttttatggatgagcatcaggacattgtaacaaatgaggatgcccgccgctggaattaccttgtcaacggctcgtttgatcagctgatgacggattttactgaacagtttcagaaattaatgatcgcgaggctgtcatctcagcaggagcttatttccgaattgagctgtccggttattttgatcgcggatacgatcggcactctgccgctcatcggcgcgattgatacgagacgggcgcgtgtgattttggagtcggtgccggaaaactgtgtcgccaaacggatcacaaaccttgtaattgatctgtccggtgtgcccattgtcgatacgatggtggcgcagcaattgtatatgctgtcgaaaacgttatttctcctcggcatcagaaccgtgttttccggcattcggcctgatgtggcacagacttctatccaattgggacttgatttttcagagtatcaaacttacggctctctggagcaggcgctcgccagcatgggtgtcacatgtgtgatcgaggaagcaaaagcatagaaaaaaggtgctccgtccagaggcggggcgctttttttgtcagcggaaaacaatttaaatatgtcggaacgtgaagattgcgttcttaaaaacagcaatatgacgccttgggggcgggcgtcggcgacacggtttatgtcaaagcaaaggaagtgaaagttttcgcaaagaaaacatatccgaaaattgtgtaaatgctgttgatttctgaatgaaaacataatagtataattatatatttcttatcagaatagtatggattaaaacactcattgtcaaaagacgaacgtccagacataaagggggagcatgatgacgtccaaaggaaacgtagatccgcatgtgatcgaaaagattatcagtgcgctggaaacgctcgatttcgggactgttcagattacggttcataattcccaagtgacacaaattgataaggtggagaaatatcgattttccctgaaaagcaaagaagtaaaacaatcttaaaaaacagccaatgacaggaggcggtacatatgaagcattcaactgttcctttccgggagagccggtatctgcacctgcccgaagtgcgctttctgcattggtgcacgaagcaatacggcataaataaaggcgtgctcaatacaattgacggctggttttatgatgcgggcgtcattccgattcccgtcaggcgtctttatgtgctggcattccttgatttcgtgaaaacgccggggcagaagggaaatatccgattcgggcacggcggattgacgaaaaaactgcatgatttcatggatatgcaggagtgcgcagcgaaacgtcaggcctgacatccttaaaatcttcttaaaatcatgcaaatttctcccattttatttataatagacctatcacgatcattttttgggaggacttttgacatgcaaactgctgcttatgagagcaaacaatctattatgcagcgcattatcacggtatttgtgtttacactgttagttgcgacaatcggcctgtatacgggccagttcattccgccggcattgatgctgccgctgtcggtcttggaggtcgtcatgatcatcgccgcattttggctgcgccgaaaaaaagccgtcggatatgtgtttgtcttttcattcgcttttatttccggaatgacgctgtttccgatcatcagccattatgcgtccgcagccggagcctatgtcgtattggaggcattcggttcttcgtttgtcatttttgcggtgctcggtacgatcggcgctaaaacgaaaaaggacttgtcgtttttatggtccttcttgcttgtcgctcttatcgcgcttctcgcagtggggatatttaatattttcagcccgctgaattccgccgccatgatggcgtattccgtcatcggaacaattgtgttttcaatgtacatcttatacgatctgaaccagatcaagcaccgggacatcacggctgacctgattcctttgatggcattgacgctttatatcgactttatcaacttgtttatcaacctgcttcggtttttcgggattttaaacagtgatgattaatcgcgcgaaaaaggcgccctgctaagaggggcgccttttgttaattttaagagttttgaatttttaatctcataagccatgagattccctttgtcatacgtttgccagctagaagtgaacggagggtttgtcataataacaaacctgtttcaaaaaatttgaaaggggaaggatattatgccttgtagtacagattatgcaacatatgtattgagagtttgtaccgatgcggattcttattctgcaaaagctacttctattgattgtgtagcatcatatgggggcgggacaatcgcaacatttgattattccatgacaattgatgtttggaacggttcaaaatgggtggctaatgaaacaaagaaaggttctttcagtcactcaacacctaaaaaagtatttaaactctcaaatcaaaaatcgttaaaaaaaggatcaaatagtgtgagagtgaggttgaagactaaaaatcgatatacaaatgtaacttccagcattaaaacacctgcatttatagtgaagagaaagtaattttaaaattatttcttctgaaacagcctgaacaaactaatgtgcaggctgtttttttataaccctcatctttttacttcaatttctatctcatagaaatttgcctttgtttttacaatactactttatgttctgtctccggaaaacagcagaagcttatcaaataaaacttcaagcatttttgtcaattccgctttttctccagcggtgaagctttccatgactcctgaaatgttggagaagtggccgggaagaaacagcatcagcttttcttttccttcccttgtaagttcgatgctgatttttcgtctgtcaccggtatgccggctgcggtttacaaagccgtcccgtgcgagtccgtcgatcaatccggtgatggtcgctttggtgacattggattttttcgccagctccgtcggactcaggctgtggccgggttcgtcaaacagaaacattaaaattttgaatttcccttcggacaatccgtgacttgagaaataatgctccatgacctgattcatttttttagacatatcaaataacgtcaaaaatgttttcaatgattcagcatccatatcggcgtaaatctcagcgcgtccggcaatctgcgagtaatccggcaaatgtctcaattccattttgtaagcctccgtaccattttagtgattcaaagtataagcttgccggattcaaaaggcaacctataaagattgacagtttttcagccaatatagtaaggtggctaatagttaacaaatgataaataaattgagaaggcggtatcgtgatgaaccatgaagtgaaaaagatcatcatagcgggcggagggatcggcggcctgtccgcagcgatttctctcggcagagcgggttttgaagtaaccctttgcgaggcggcgtccgacatgcgaaaaagcggagcgggcattcttcagcctcaaaatgcgcttcgggtgcttcgggaaatcggtgtgtatgatgaatgctgtcaacacggctttcaaacggattggctgaagcagcatgatgaaaacggaacgctgcagtttaaagtgagtgaggcgtttttagatgattcattgccggggcggaataatatattgcggcaaacattaaacgatatcctcagcaagcatgctgaggcggcgggggtcacgattctgcccggtaaaaaagtcgtgtcttacgaagaaacggcagatgaaataacggtgcattgtggagacggaaccgcgatgacggctgacatcctcgccggctttgacggcatccgctccgctgtccgcaatcacatgctgcaaagggaagtgaaaacagagtatctcggcatgggagcgcacagattttacatttcttttcccgagccggtttttcatgattcgacactgatgtataaaaaggggcagacgcaggtcggggtcgtgccgctctctgaaaaaacaggatacgtatttatcatccggccgtatgacgctgacttcagggatgacgaggacacgcgttttgaacgggtgagagacttgctgcgcggaattccgggagtgaagtttgtgacagagaatatgtcaaaggaatatcccgttttgtttcataagattgagcagatggcggtcaaagaaccgtggcacagaggccgcgtcgttctgggcggggatgccgtccatgcaggagcgccgacattggcgcagggagcggcgatggcgattgaagacgcgattgtgcttagtgaagaactgcaaaaacacgaaaaccatgaaactgcatgtcaagcatacttcgaaagacgggcggagcgggcattacaggtgcagaatctctcatctgaaatcgtccgccgcgagataaagggaacgcccggcgtccaagacatcatcggtgaatgctatcgattgctcaaagagccttattaaatacagaaagtccagaacatggcgtctggacttttgtcagtcttgttcagatttattccgtatccgctcaatcacctcatgcagcccctcaggcttgtgaaactccaccggcgaactgcctttttcaaacgagatcgtctccgcctcaatgagcgcgacatagcgcccgttcacttttgcgagatggatggattcgccgaaatcagccagtaatcctttaatctctgtttctccgactttcattttcagctcggcttccggcgtgtgttcaatgatctgcgcggatgcctcgatgacttgatgggtgtcgaggcgctcctgaatttcccgcttttcactcgcttcccaaatttcaatgtcgtgctcaaactgctgaagctcttcgctgttttcttcaaaagtttcatacacgtgctcctgcaccatgttcatgacttggtttttcatgatttccggcatcgattcgccatattcgacaaatttgagaaaatcttcgaaataacgggcgtgcgaggcctggtggattttcagctcatgctcttccgtcatgccttcttccggcatatacggatattgaatgcttttcatgttttttgtcgtgatggccatttcgacctttttaatgagagacgaggcgtctgagatgcgggcgaccttcggctcgaaatcgcatttcatcataaagacgaatttgtcctcaaaatatttgcgcggaacggccgaagccacgataaaaacaccgccgcgcacggcgctcgtgtcaagataagtacggacgaactgttcgcttgcctcgataaatgcttccttcgtatccgcaagtctggcgcggttgaaaaggttgtaattcggatttgaatcaagctcatggcccggctccgtgataaaatggccgatttttgtggggacctgctcggattgcggatgccgttcagctttccgtttgacgattttcttcaattccccgtcaagaaaatccttcagctcgctttcttcaaattcgtctgtgtcaagggtctggaaatgtttgaactgtttgtttgcctgttcgtcttttccttccacttgaatgacataaaacgataaaaacttgatttcaaaatccatatgtgaactcaccttatttctgtatttaacaagcctctccagtatagaaaaaaccgttatcaatcgtcaatccggggattgatccgtaacggcggataattggccggtgaaaagggcactgtagttggaaggaacgcatcaatgtgtaagaaagggtgttattcatgaaggaaacaggtccgattccgcagccgaagacattcggtcctctcggcaatcttcctttgcttgataaagacaagcctacaatgtcgctgatcaaactggcaaacgagcaggggcctatttttcagctgcataccccggcgggcgccattatcgtcgtgtccggacatgaactggtgaaagaggtatgtgatgaagagcggttcgataaaagcattgaaggtgctttggagaaagtccgggcgtttgccggtgacgggctgtttacaagctggacgcatgagcctaactggcgaaaggcgcataatattctgatgccgaccttcagccagcgcgcgatgaaagattatcattcgatgatgactgatatcgcggtgcagctgattcaaaaatgggctaggctgaacccggatgaggccgttgatgtgcctgctgatatgacccgcctgacgctcgatacgatcgggctttgcggctttaactatcggtttaacagctattacagggaaacgcctcatccgtttatcaacagcatggtgcgcgcccttgatgaagcgatgcaccaaatgcagcgccttgatgttcaggataagctcatgatcaggacgaagcgccaatttcatcatgacattcaggcgatgttttcgttagtagacagtattatcgcagagcgccggtcaggcggacgggatgaaaaggatctgctggccagaatgctgaatgtggaagacccggaaacgggcgaaaaacttgatgatgaaaatatccggtttcaaatcatcacgtttttaattgccggccacgaaacgaccagcggcctgctttcctttgccatctattttctgctgaaacatccccgtgttttggaaaaagcctatgaagaagccgatcgggttttgaccgatcccgttccttcttataaacaagtactggagcttagttatatccgaatgattttgcaggagtcattgcgcttatggccgaccgcgcctgcgttcagcctttatgcgaaagaggatacggtgatcggcgggaaatatccgatcacgccgaaagacagaatttccgtcttaattccccagcttcaccgtgataaagacgcgtggggagacaatgcggaggaattttatccggagcggtttgaacatcctgatctagtgcctcaccatgcgtataagcctttcggaaacgggcagagggcgtgtatcggtatgcagttcgccctgcatgaagcaactcttgttctggggatgattctgcagcattttacctttatcgatcacaccgattatgagctcgatattaaacagacactgacgattaagcccggcgactttcatatccgggtgcggccgagaaacaaaggagccgttgcggcagctctcccggcggctgaaaaagcggcggaagacgtcgaaaaagaaaaacgggaaacaaaaggcgcatccattatcgggcttgataaccgaccgcttctgattttgtacggctcagatacgggaaccgcagaaggcgtggcgcgggaacttgccgatactgccgggatgcacggcgtccggactgaaacggcgcctttaaatgaccggatcggaaaactgccgaaagaaggagctctcttgatcattacgtcctcttataacggaaagcctccgagcaacgcgggacaattcgttcaatggcttgaagaagtcaaacccggggagctggaaggtgtccgatatgccgtcttcggctgcggtgatcataactgggcggcgacatatcaggctgtgccgagactgattgatgagaagcttgccgaaaaaggggcggaacgcttttctgcccgaggcgaaggggacgtcagcggggattttgaaggaaagcttgatgaatggaaaaaaagcatgtggacggacgccatgaaggcattcggtcttaagctgaatgaaaatgccgaaaaagagcgaagtgcgctgggccttcaatttgtcagcgggcttggcgggtctccgttggcacagacgtatgaagcggtttacgcatccgttgcggaaaacagggaacttcaggcgccggaaagcggccggagcacaaggcatatcgaaatcactctgccgaaagaggctgcctatcatgaaggggatcatctcggcgtgctgccggtaaacagcaaaaagcaggtcagccgtgttctccgccggttcaatctgaacgggaatgatcaagtgctgctgacggccagcggacagagcgcggctcatctcccgctcgatcggccggtcaggctgcatgatcttctgagcagctgtgtcgaattgcaggaagcggcatcaagggctcaaatccgggaaatggccgcttatacggtctgtccgccgcacaaacgggaattggaagattttcttgaggagggcgtctatcaggagcaaatcttaacatcgcgcgtctcgatgctcgatctccttgaaaaatatgaagcgtgtgaacttccgtttgagcgatttctggagcttttgcgcccgctgaagccgcggtattattcgatttcaagttcgcctcggaaacatcccgggcaggcctcaattaccgtcggcgtcgttcgcggccccgcccggagcggtttgggtgagtatcgcggagtcgcttcgaattatttagcggaccgccgccctgaggatggtatcgtgatgtttgtccgcactccggaaacacgattccggctgccggaagatccggaaaaaccgattattatggtcggtcccggcacaggagtcgccccgttccgcggatttctgcaggctcgggcagcgttaaaaaaagaaggaaaagagctgggggaggctcatctgtatttcggatgcagaaacgatcatgattttatttaccgtgacgagcttgaagcttatgaaaaagacggaatcgtgacgcttcatacggctttctcccgcaaagaaggcgtaccgaaaacgtatgtgcagcacttaatggcgaaagacgccggcgctttaatttccatcctcggccggggagggcgcctctacgtatgcggagacggcagcaaaatggcgcccgatgtagaggcaacgctgcaaaaagcgtatcagtcggtccgcgaaacagacgaacggcaagcgcaagaatggcttttggacctccagacaaaaggcatttacgcaaaagatgtttgggcggggatttgagcgatgtgatgaaaaggactggatgactccggtcctttttttacatcacccaaaaaaaaccttcaagtttttcagtccctttgcatacaataacttcagcccgcctgttgggcggctgtctttgatattcatttttcgtttttagaagtttgtgttattcttatatttggtatctcctattttcagaccgggtctgataaggtaccttttaatgccagaaaaaaatgtgaaacgaagaacggatatcctgcgtctaatggctggcgggataagatgttcaataggcatgacacgaatgataaatatatcgttttttaaaatggtgtgtttatggggctgtgtgatgctttcgttttgctcggaaagcaggaattgaagcaaaaagtaagaatacagatttaaagtgtttaggaaagtagaggttgccatgaagaaattattttcttacagacttagtttttttgtactggctattattttgttttgggccaaaacgtatttagcctatcatgctgaattcaaccttggggtgaagggtccgacgcagcagtttctgcttgtgatcaatccgttctcaagcgccattttctttttaggactggcattgtttgcgaaaggccgcaaatcagcgattatcatggtgattattgatttcatcatgacgtttattttgtatgccaatatcctattctatcgattcttcgatgatttcttgacattcccgaacttaaagcaatccggtaatgtcggaaatatgggagacggcatcttcagcattatgtccggccatgatattttatactttgttgatattattattttaatcgcgcttctggtgtggagacgtgagctgaaggaattcaagctgaaaaaacggtatacgtcattaattatcgtgacgggtattgtgttgttcttcgtgaacctggcgattgccgaagaggaccgcccggagctgctgacaagaacgtttgaccgcaattacattgtaaaatacttaggcctttataattacacgatttatgacggcgtacagacggcgcagacggaatcacagcgggcatatgccagcagtgatgacctgacgagcgttgaaaactatacatcgtcgcattatgcgaagccgaacgccgagtatttcggcaaggccaaaggcaagaacatcattaagattcacctggagagcttccaatcatttttgatcaattacaaacttgacgggaaagaagttacgccgttcctgaataaactcgcccgcggcggagaggacatgacgtactttgataactttttccaccaaacgggccaaggtaaaacatctgacgccgagctgatgatggataacagtctgttcggactgcctgaagggtcagccttcgtgacaaaaggggaaaacacgtatcaatcgcttcctgccatccttgaccaaagtgagggctatacaagcgccgttttacacggtgactacaaatcattctggaaccgtgaccagatttacaaacatatcggctacgataaattctttgacgccagcacatacgatatgtctgatgacaaccttgtcaatatgggactgaaggataaaccgttcttcaaagaatctataccgaagcttcagtcgctgaaacagccgttctacgcgcatttgctcacgctgacgaaccattatccgtttacgcttgatgaaaaagacgcaacgatcgaaaaagcgaaaacgggcgacgcgactgtggatgactatttccagacggcgcgttatcttgacgaagcgcttgaacagttctttaaagatctgaagtcatccggtttatatgacaactcggtgattatgctttacggagaccattacggaatctctgaaaaccataaccgcgcgatgaaagaaattctcggcaaagaaattacgccttatcaaaacgcgcagaatcagcgtgtgccgcttatgcttcgcatccccggcaaaaaaggcggggtgaaccatacgtacggcggtgaaatggacgttgtgccgacgatccttcacttggaaggcatcgattctaagaaatatattaatttcggcaccgatctcttctcgaaagaccatgatgatacggtgacgttccgcaacggagattacgtcacgccgaaatatacttccatctccaatgtcgtatacgatacgaagacagggaaagaactgaaaggcaatcaggaaacgaaaaacctgaaagccagagtcacagagcagctgaagctgtctgacagcgtgatgtacaaagacctgctcagattccacaaattgagcgactttacgccggttgatccgtctaaatatcattacggcaaagaaaagctgaatcaggataataaataatagaaagagccttacggaatttccgtgaggctctttttttgtgtgtatcttcaccaatctgaaaaaagagagagcttttggtcacaaagggcgccaatctctcatatcttacagtagattttgaaaccggtggtagagaatcggacaaattatcgggttggtttctcttatacgggcggtttcgaatccaatattcacagagaagaggggtagagatgaaagcagtcattctctgcggcggaaaaggaacgagaatgagcgaaatcaccaatgaacgtcccaaaccgctcgccatgataggcggcaaaccgattctatggcatattatgaaactctatcaatactatggcgtgaacgaatttatcctgcttcttggtttcaaaggagagatgattaaggaatatttcttagattatgactggaagaatcacagcatgacgctggacagctctaccggagaagtgcggatattgggaacatccgagccgtggaaaatcacttttttagacacgggggaacacacgcagacagcggggcggcttttacaggcgaaggacatcatcggtgatgaaacctttcttatgacgtacggggacggactggcgaacatcaacctgtttcatctgatcagctatcatcaatcaaaaggggctgcggcaaccgtcaccggtatagaaaagacctcgcaattcggaacgctgacggttgaagacggtatggcgaaaagcttttctgaaaaaaactcaagtgacggcatcatcaacggcggatttttcgtgctcagcccgaaggtatttgattatctgccgaaagacagggacgtcatgtttgaagaagaaccgctgaaggagctggcaaaggacggcgaattggcggtataccggcattacggtttctggacggcgatcgatacgtataaaaatctgctggaaattaacaagatgtgggaccggggacaacatgtatggaaggtatggtgatcaagtttgagtttctggaaaaataaaaatgtgtttgtgacgggatgtacaggtcttttaggaagctgcttggtgaaggaactgatcgatcagggggctaatgtgacgggacttgtccgtgacactgtgcccaagtcgaacctgtatcagggagaacaagtgaagcaaatgaatatcgtgcagggcgcgcttgaagatctggatgtgattgagcgggcgctgggcgagtatgaaattgacacggtctttcatttagccgctcaggcaatcgtcggcgtcgcaaaccgcaatccgatttccacatttgaagccaatattctcggcacatggaacatccttgaagcgtgccgcaggcatccgctcatcaagcgggtgatcgtcgcgtccagtgataaagcgtacggcgaccagccgacactgccgtacgatgaaaacatgcctcttcagggcaaacatccgtatgacgtatcaaaaagctgtgccgatttattaagccacacatattttaatacgtacggacttccggtctgtattacgcgctgcggcaacttgtacggcggcggagatttgaacttcaaccggattattccgcagacgattcagctcgtgctgaacggtgaagcgccggaaatccgcagcgacggcacatttatccgtgattatttttacatcgaggatgcggtcgaggcataccttttgctggcggaaaagatggaggagctcaatcttgcgggagaagcgttcaacttcagcaatgagattcagctgacggtgctggaacttgtagaaaaattcttaaggcgatggacagtgacctcaagccgaaagtgcttaaccagggaagccacgaaatcaagcaccaatatttatcagcggaaaaggcgaggaagcttctgaattggacgcccgcgcataccattgatgaaggattagaaaaaacgatcgaatggtataaagccttttttcaaaagtaacagaaacagaggtgagagaaagacgtgacaagcgcatattgcacagttttatcaaaaggaaggctgtatcaggctatcgctttgttcggctcattgaaagcggttcaggcggacgcccccatttttactttgtgtatggatcaagacacctatgacgtgcttcaggcaatgcgtccggataatgtcaccttgattcaggtgtccgcactggaaaatgaggagctccttgaactgaagcggacgagggatcagagcgaatactgctggacggtgaagccggtatttctcgaattcgtgctggacggacatccggaattagagcgtgtcacgtacattgatgccgatttgtttttcttcgctgatccgcgcgcgatttttgacaatcagccggattgttcggtgcttctgtcacggggcgatatcgtcattccctcatttgaaaaacaggaaatcgacatgctgcagcgtcttttaggccggtataattccggttttctcagcttcaaaaccgacagtgccggcacagattgtctcagatggtggaaagaacgctgccttgaagaatgcaaaaatgcgccgggcgaaggaaaattcggagatcaaggctacttggattacatgtccggtctgttcccgaacgtgtgtgacatcaccacgcccggcgtgaatatcggccattggaattacggccgccacacgttttcatggaaggacgggcgtcttgtgctcgaagacggaaatccgctgattttctatcatttcagcggataccggatcgtcacagccggcgacattcggcagattcatgagacggaccggaccgacctgccgtttgtccatcagctttatcaggacattctgaagcgggtgatcgggacggtcagcgccgtctgccccgagttcagcggctttgcatctgaggatgataacaaataaatgatcatatacaggaagtgaacgaaaagtgaaggcaagcgtcattgttcccgcatataattccaaggagaggctttataacagcctgctgtccctgaatgaacaggaatgcacagagccgttcgaagtgattgtggctgacaacggttcggaagacggaaccttatccatgcttgaatcattcagcgcgaattttccgctgatttttgtgagaattaaagaaaacagagggatcgcttacggccggaatcaggcggtccgcaatgccagaggcgatattttgattttccatgacagcgacatgcttgccgaaaaggatttggtggcgaagcatatcaaggctcatgagaaccgggacgatcttgtcgtatgcggtatgttctggaagcggatttacagcttttattatgaccgttttgaaaaagagcataaggaaaaactcgccgaactgtatgaagagctgccgggcgataaagagccgctccttgatgaaagtgacatcagagacggaagctttcttgaacgatgctttgatttagataccgactttatccgggtgctgaaaagcattttggaaaaatacggagatgatttgaacggctaccgtctgccatggcgttttttcattacgaacaattcatcagttaagaggcagcacgtggcagatctcggcctgtttgatgaaggcattgtcagatacggctttgaagattatgatctcggcatcaggcttcatcagtcgggaatgagatttcagctgcggcgcgatatcatgagcgtccatcaggagcatccgagcaactgcgcttccgttgatgacatcagggcgaatatcgcgtacatgtgcgacaagtacaatgacattcattcgcttgacgtgcacctcgcgtttaacggcccgtttgacgcggagttaaccaacagcataatggcagacatcgaagtgctgcttgattatgagaaatatgaaagcctgctgcacatttttctcgaactgctgcacgcggttaaagaccgcaacctcgatccggactggaagacgaaaagcccgcggatcacggcgaacagcttccagctgccggaggtcggaaagcttttggcaaaagcggaaaaaaagctgggcgtcacgcactttgcaagggcgttcaaagcgctgactgctgatttactgcatgtggatcttaaataaattggatgtgatatggtgagtaaatatcatttttcaaccattgtttccagaacgcatatctttaaactgatgccgatgattcattctctccatgagcattgccgggattttcatctgtatgtgctgtgtgtcgatcagaaagcgtacgaactgcttcagcaggtgccgtgggaacatgtcacagcggttcagctccatgaaatggaggacccggagctgcttgaagcaaagggcggccggacgtttcatgaatattgctggacgctgaagccggcttttctgttccatgtgatgacggagtatgatgaagccgaatattttgcccatttggacaccgatctctttttcttctcagatgcgggcgagctgtttgcggaaaagccggatgcttccctttttctgacggatcaccgcaattcagaacggtttgcgtcttattacaagctgacggggcagtacaacaccgggtttgtcggcgcgcggaataccggggaagcgtatcgggcggtctggcagtggagacaggattgcatctcctattgtacggtggagatgaatgaagaaaaaaagacatacggtgaccaaaggtatgttgaaaagtggcccgcgcagtttgaacacgtgcatgtcacggagtcgatcggcgcgaatgcggcgctgtggaatattgagcaatatgacgtcagcctgcgcgacggggctgtatatgtcaatgacaccccgctgattttttatcatttttcaggctttacgctcgtcacggagaacgaattcaatctctgctggtactatcacattgatgatgaggcgacagtcagtatgatttacgtcccgtacatcaaaaacgtaaaaaaatggattgatgaaattcaaaaagcgtttcctgatttcagagacgggtttattccgaaatatgcggttcctgacactcatttttatacggttgaaacataaaatccctgccttttcggcagggatttttttatgaatgccattcttttaatgttttgtcgctcggcaggacaaaggcgagcagacctaaaacgggcagaaaggcgacggctgtcatggtcggcgtcaatcccgctgaatcaataagagctccgagcgcaaccgctccgatcgcgcccattccgaaggcgagcccgaccgtaagccctgacatcgttccgattttgccgggaacaagctcctgcgcgtagacaaccgtcacggagaagctggacatcagaacaacgccgatcagcgccagtacgccataggcgatgacaggtcccgcaaacggaaggaaaatcgtcaagggagccgatgccgtcatggaaacgatgatgacgttccgctttccgaaacggtctgcaagcggcccgccgagaaacgttccgacagctccgaaaaataaaaagacgaagatgtagctctgtgcctgctgaatgctgacatgataggcattcatcgcatagaacgtatagaagttgccgatcgcgctcacataccaggagcgcgcgaaaattaagaagataatcatgataagtgcaagaataatcggttttgtaatcacggtctgcacagcggcggccggtgattttttacttgcggcgcgcaaatgaataaggcggcctttataccatttggcgatataaatgagaaacagcacagcgattgcggcgactagcgtaaaccagacagagccgaattgaccgagcggaacgagaatcagcgcggtaatcaagggcgccatcgcctggccggtattccctccgacttggtaaatcgattgcgccaatccgcgcttttcgccggcggccatgtaagcgacacgcgatccttcaggatgaaagacggcggagccaaggccgataaaaaagacacagcataaaatcgtcagaaaagacggggcgaacgcgagacctaaaatgccgagcatgcttgcggtgagtccgagcggcaaagcatacggcatcgggcgtttatccgtataccagccgatgacgggctgcatcacggaagacaccatattcagcgtaaaggcgataattccgagctgcgtaaatgtaagattcatggaacgttccaaaatcggaaacatcgccggaatcaccgcttgcagtgaatcgttcagcagatgacagatcccgataatgaacaaaatagaatacatggttgtctcgggacgatggacaggtttttctttaagcggggcggcaattgccaaagtgattctcctcctttttatgtaaacgaagcatacaccatattattcataaggtgaatgaattatcaagggcaaaaaaggctcttctttctcaaacagaaaaaagagcctccctttttatttatttaacaaactgtgttttctcgaatacatcatatataccacgatcccggcggcgatccagatgacaaaggcgagccatgtcacgcccggcaggctgcttgcgagatacaggcataagcatgcgctgatgatcggcacaaaaggcacgaaaggaacacggaaggaagatttgatctccggatgtttctttcttaaaacgatgacggcgatcgcaatgactgtaaaggccgccaaggttcccatattgacgagatgcgccaaggttcccagatcaataaaacctgcgatcccggcggcagcgatccccgtcacccatgtgttttgaaacggtgttttaaaacgcgggtgaaccttggaaaacatgcggggcaaaaggccgtctctgctcatcgcaaatgttaggcgcacctgagcgtaaagcagagcgagcatgaccgttgtaatcccgataatcgcgccgacggaaataatgcctgctattttgttctggccgacaaattggagcgcgaaagataccggatctccgacattcagcttggtgtacgaaagcattcctgtcaggacgagcgataccgtaatgtaaagaacggtgcagatggcaagcgcgccgatgattccgacaggcattgatttctgcgggtttttcacttcttccgacgcgtttgacacggcatcaaatccgagatacgcgaagaaaacggtcgcggcgctcgtgatgacgcctttcattccgaacggcataaacggcgaccagttttccggtttcacgtagccgaaaccgacgacgataaacagcagaatgatcgcaattttcatcaatacaatgacattgttaaagcgggtgctttctttcacgccccttgaaacaatcgcggtaatgaccaaaataatgataacggccggcaggttgaacacggcacccgttttgctgccgggtgcggcggtcagcgcctccggaagatgcagcccgaatcctgcaagaagcgactggaaataggatgaccagccggttgcgacggcggcgagcgcgataacatattcaagcattaagtcccatccgattaaaaacgcgagacactccccgagagtaacatatgaatacgtatatacgctgcctgaaatcggaatggatgaagaaaattccgcataacaaaacgcggcgagcgcgcaggcaaggcccgcgagcacaaacgacagaatcaaagccggtcctgcgcctgtcgcggccacagtcccggtaatcacaaaaatccccgtgccgacaacacagccgattccgagcaaaaccaagtcaaaagcgcttaacgagcgggacaggctggtctgtttgctctgggcctttaagtcggccagcggctttttccgaaatagtaaagacatatgggtcctcctgaaaattcataatattcttatcattatatacactgacgtttgtattatattgtcgaaatttctcgcagtcaattaaagaattttccactttaaaaggacaaagctaaaaagcgtcgatgcacggaaggaaagggaattttattgtgaaatagttcaattttctcaccttaagaccgatacaaaagatgactcatcaactaatttcaagtttcggtgaaagggagatgtttacatgtttcaatatgaagaactaaataagcagtttatcggcggccgatggagggatgggagcagccggaacgtattggaaaacagaaatccttatactcaaaaagtcatcacctcattccgaaaagcgacgcctgatgacgtggatgcggcatatcgcgccgcggctcttgcgaaacaagaatgggacaaagtaaacccttttaaaaagcgggccattttggaaaaagccgtttctttcattgaagagcacgaagaagcgattatttacttaatcatggaggagcttggcggaacacggctgaaggctgagtttgaaatcggacttgtcaaaaatatgataaaagaagccgcaacatttccggtgcggatggaagggaaaattctcccgtccacgattgacggaaaagaaaacaggctgtacagaatacctgccggagtcgcaggggtgatcagcccgtttaatttcccgtttttcctttcgatgaaatctgttgcgccggcactcggcgcggggaacggcgtcgtgctgaagcctcatgaagaaacgccgatctgcggcggaacgcttatcgcgaaaatttttgaagcggccggcgtaccggacgggctgctgaatgtcatcgtgacggatatcggggagatcggcgacagctttgttgagcatcccgtgccgcggataatctcatttacaggctcaaccggagtgggcagctatatcggacagcttgcggtcaaacactttaaaaaaccgctgttggagcttggcggaaacagcgcgctgatcgtgcttgaggatgctgatcttgaatacgccgtcaatgcggccgtattcagccggtttacgcatcaaggccagatctgtatgtcggcgaaccgcgtgctcgttcacacatctgtttatgacaaatttacagagctctacgaagcgaaagtgtcatcgctgaaagtcggcgatccgatggaccctgatacggttatcggtcctttaatcaatgagagacaggcggaaggcctgagacggtctgtcgaaaaagcgatagaagagggagcggttccggtgctgtccggccgattcagcggaacggtcgctgagcctgtcattttaaaagatgtgaaacctgagatgagcatcgcgaaggaggagctgttcggaccggccgtctgcatcatgccgtttgaaacggaggatgaagcggtaagcatcgcaaacgcgacaccgttcggtttaagcggagccgtgcatacggcaaacgtggagcggggcgttgagtttgctaagcggatcgaaaccggcatgattcacgtcaacgatacgaccattaatgatgaaccgaacgttgcgttcggcggcgagaaacaatcaggtctcggcaggctgaacggcgaatggagccttgaagaattcaccacgctgaaatggatttcggttcagcatgaaaaacgccaattcccatattaagaaggagtgaaagaaatgagtatacagacggagcagcaaacgcacagcctgcttgacgcttttgtcaaagttgcgccttttttaaacagcctgatccaagatgacatcaccatcggaatttatgatacagaaaaattaatcgtgaatattccggctaaaacgttttctcttaatgtaaagccgggagatccgctgcaaaaaggggacatcattacagacgcgatccgcatgaatcagaagaagacaagcatggtgccgaaagagctgttcggatttccgctgatcgccagagcgattccgcttcacgatgaaaacggaaaagtcatcggcggcgtcggtctcggcacgagccttgaaaaatcagccaagcttcatgatgtcgctgaaagcctgtccgccgtcgtggaacagaccgcttcggcgatcgcggatatctcagaatccatcagcggtttctcagcacagatgaccgggatttccgctcaggcgaaacaagtcagtgaaagcgcgggagaaatcgccgacatttccgttactgtcaagggcatctcggatcaaagcaatctgctcggtttgaatgcggccattgaagccgcgagagcaggagaatccggcaagggcttttccgtggtggcggatgagatccgcaagcttgccactcattcaaaagacaatgtcggccaaattgaccagattacgaaaaaaattcacagcctgctgaaagggctggaggactcaattgaatccatcaaccagaacacggacggtcaagcggcggcggtagaacaaatttctgccacgatgcaggagatttcgggaagcgcccagcatttagcgaaaatggctgaaaacgtgctcggagaatcataaaaaagggagcttacgggctccttttttgttttcccttatcaatcggaaactgcacttacacgtttgatccgtcatgctcaggggtacacatacgaatacatcaccaatgataaaggagagtcttgtatgtctgatgcaaatctgcacaacccgctgacgaaatatgatcatgatgaatttccaaaacaatatcaagaaccgcccggtttgcagaaagagatgaagcctgtgccggactgcggtgaaacaagctataaaggagccggcaagctgaagggaagaaaagccctcgtcaccggcggcgattcaggtatcggccgggccgccgcgattgcttatgcccgggaaggggcggatgtggccattaactatctgcctgaggaacagccggatgccgaagaagtgaaagcgttaattgaaaaagagggaagaaaagctgttctgctgccgggagatttaagcgatgaagcgttttgcggagaattggcggaaaaagcgtatcaagagcttggcggtcttgacacgctcgctcttgtcgccggcaaacagcaggcagtggatgatatcagcgatcttactacagaacaaatctatcaaacatttgaagtcaacgtattctcgctgtattggctcgtcaaagccgcgcttccgtatctgccggaaggcgcgtctattatcacgacaacgtccgtagaaggttataatccaagcccgatgctgttggattatgctgcgacgaaacatgccattatcggttttaccgtcggcctaggaaagcagctggcgaataaaggaatcagagtcaactcggtagcgccggggccgatctggacaccgctgcagatttcgggaggacagcccggagaaaacattccgaaattcggcaaggaaacaccggccgttccattaaagcgtgccggacagccggcggagctggcaggaatttatgtctttttggcctcagaagaatcaagctatgtgacatcccaaatttacagtgtaagcggaggaattccgacagcgtaatcaaaaaggagctgcccttcatacggggcagctcttttttttgatgttatgtgccgagcacgttttgattatacaggacactcggatgtgacggatgataggaggcggctttgtcgttatgaatcttcgctttttctctgtcgccgagctgccagtggcagacgcagagctgcagatgggggtaccaggtggaatattcgagctgggtaaagcctgcatcactgcttttggcggatagggcgagctcataccaaaacacgccctgccggtattgccgtttctccgcaaaatagtcgccgagcctgcagcagaactccggccgcggacaatcgatcagaaatgattttaagagagacgtcatggcggcctcttcatggccgaccgccctgtagcaatcggatagatattggcacgttctgatctcgtcttcgatccagcactgttttgtggaaagaaaatggtgataatacgtgatggcgcgctgatactggccgtgatcctttaattcattcgcgaagtaaaacaaatcgcgcggtgtcatcgattcactgttttccgccattctctcataaatcttcaagttgcggtccgagggaggcgagtgctttttttcggatttccggtgtgtgacggcaatatcggtttctatgatgtttccgtatacctcaagatactcatgcacggctccgatccagcggaaccctttttcacgcttgacgagtcggttgcggcggtatctgaagctgacctctccccgatcatcaaagccgacgtgataatacatggataccgcgtccacctcttttgaaagcgacgccttcagttcaatcagcttttcacggtcctttaccgtcagcatatcgtcggcgtccagccacagaatataatccatttccgctttcgaaaacacaaaattacgggcggcggcaaagtgatcgatccattcaaaatcataaatcttatccgtataacgggccgcgatttctttcgtccggtcggtcgagcccgtatcagcaatcacaatttcatccgcaatgtctttgacggaatcaagacagcccgcaagcacttcctcttcatttttcacgataacgcacaaactgacgctgatcatgtcatcacctcttcccctccagtgtataaaaggagaggcggaaacattcttcggacaaaatgatctcttccaagaaatttgtctgtccttttactagttttattacagcgcctgatttaaaatgaacacatgaacttacgtgaggattgataggaaccatgagcatcataaaagcggaaaacctttataaaacatacggagataagacattattcgaccatatctcctttcatattgaagagaatgaaagaatcggtttaatcggcccgaacggaacggggaagtctacgcttctgaaaaccattgccggccttgaatcaacggaggaaggcgagattacggcttcaggaaacgtgcatattgagttcttgcatcaggaccctgagcttccggccggacaaaccgttcttgaacatatttattccggcggatcagccgtcatgagaacgatgagagagtacgaaaaagcgcttcaggcgctgaatgaagaaccggaaaatgaccagcgtcagaaacacctgcttgatgcgcaggcccgaatggacgcgaatgatgcgtgggaggcgaatacgttagccaaaacggttttaaccaaacttggcgtcaccgatctgatgaaggatgtcagcgagctgtccggcggccagagaaagcgcgtcgcgattgcgaaaaacgtcatccagccggctgacctgctcattttggatgaaccgacaaaccacttggacaatgaaacgattgaatggctggaaggctacttatcgcaatatccgggcgccgttatgcttgtcacgcacgacagatattttctgaacagggtgacgaacagaatttacgagcttgagagaggcagcctttatacgtataaaggaaactatgaagtattcctggaaaaacgggccgaacgggaggcgctggcagagcagaaagaaacaaaacgccaaaacctcctgcgccgcgaattggcgtggctcagaagaggagcgaaagcgcgctcgacgaaacaaaaagcgagagtggacagagcggaggcgctcaaggagcaaaaagggccggcagtctccggatcactcgatttcgcgatcggttcccaccgtctcggaaaacaagtaatcgaagccgataacgtctccattacctataacggccaagcgctgatcagccagtttaatgagcttgtcatccctggggaacgaatcggcatcatcgggccgaacggaatcgggaaaacgacacttttaaacagcctcgccggcagaattcagcctgacagcggcaatatcaccatcgggcagacggtccggatcggctactacacccaggatcacagcgaaatgaacggcgatatgaaagtcattgaatatataaaagagacggccgaaatcgtcaaaacggcggaaggcgatgtcatcaccgcggaacaaatgcttgagcgttttctgttcccgcgtccgatgcagcagacatatatcagaaagctgtcaggcggggaaaaacgccgtctgtacttgctgaatgtactgatgcaggagccgaatgtgctgtttttagatgaaccgaccaatgatctggacacagaaacattaagcgtgctcgaggattatatcgaacagttcccgggcgtcgtcatcaccgtatcccatgaccgctatttccttgaccgcgtcgtggaccgcctgatcgtatttgaaggacacggtgtcatttcccgtttccaaggttcatacagtgaatacatggaacaagcaaaagagaagaagacggcggtaaaacagccggccgaagagaaaaaggcggaagaagagccgaagaaaaagcgcaaaaagctttcgtacaaggatcagatcgaatgggacggcatcgaagacaaaatcgccggccttgaagaaaagcatcagcgtctggaagcggaaatcgctgaagcgggaagtgatttcggaaagatacaagaactgatggccgaacaggcaaaaacggctgaagagcttgaagcggcgatggaacgctggaccgaattgtcactgatgattgaagaacttgagaattaagaaaagccggtacggcccccgagaagatggcgggtcataccggctttttttatcttacacagatgtctcccggcgctttaaagacaaaggttccgtccaagccaagtttatccggcataaaaagtttacgtttacgttaaggttcaaatggtgtataatagaaacagatacgacaagagggggattcaccttggaatggatgaagattgatcaagttgccaagcgaagcggattgacaaaacgaaccattcgtttttacgaggagattggtttgattcctgctcctaaacggacagaaggcggcgtccggctttactctgaagatgatatggaggagctcgaaaaagtcaccagcacaaaagaagtgctcggtttttcccttcaggaacttcagcagtttatggagatgagccgtcagctggaattaaacaaagaggggtacttgttgtcactggatccgaaggaacggaaagaaaagctggaagagattcagcacgctttgaaccaccagcttgagatgattgatgagaagatcagcacatttcagcattttaaaacgcgccttaacggaatgaaagaaaaagctgaccgcgccattcaatcaatcgaatgattttgctgtaaacgctatggatatagcgtttcttttaatggataaaacaggaggtctggtcaaatggatacatcatcacaacagaaaacaggcttattcagccagccgaaagccgtttgggcggttgcgtttgcctgtgtgatttcctttatgggaatcggtcttgtcgatccaattcttccggcaatcgccgcacaattacatgcttcacctagtgaagtatctctgttatttacaagttatttgctcgttaccggttttatgatgtttttctccggcgcgatttcaagccggatcggcgcaaaatggacgctgcttctcggacttatttttatcatcgtgtttgccgctctcggcggaagctcaagttcaatcgctcagcttgtcggctatcgcggcggctggggacttgggaatgctctctttatttcaaccgcgcttgccgtcatcgtcggtgtatctgtcggcggcagcgccaaagctattattctgtatgaggccgcgctcggactgggaatttctgtcgggccgcttgccggcggagagctaggcagcctttcatggcgcgctccgttcttcggagtgtctgtcctgatgtttatagcgctttgcgcgatttcactcatgctgccgaagctgccgaaaccggcgaaacgcgtcggtgtgtttgatgcgatgaaggcgctcaaatataaaggccttttgacaatggcagtatctgcattcttatacaactttggattttttattttgcttgcttattctccgttcgttctggatttagatgaacacggtctcggatacgtcttcttcggctggggccttctgctggcaattacgtcagtctttacggcgccgctcgtgcataaagcgctgggcacagtgcgttcgctcgtcgttctctttatcgcctttgcggccattctcgttattatgggggtctggactgaccatcagacgttgatcattacatgtatcgttgttgccggtgctgtcctcggtatggtgaatacgatcatgacaaccgctgtgatgggtgctgcgccggttgaacgttccatcgcgtcttcagcctacagctcagtccgctttatcggcggtgcgctcgctccgtggattgcgggaatgctgtcagaacacttcaccgcaagcacaccatatacagtaggcgggattgtcgtttttgtcggcatgcttgttcttcttatgggacgcaaacatcttgccggaataaaagccggacattaaaaaaaggaacttccgcacgggcgggagttcctttttgtgtttacagcactttcgtcgtccaagattcacaattccatgtttccgtcgcgatatccatgtagaactcgggttcgtgggaaatcagcagaatggagcctttgtattctttcagcgcgcgtttcagctcttctttcgcatcgacatccaggtggtttgtcggttcgtcaagcacgagcaggtttgtttctgaattgatcagcttgcacagtctgaccttcgctttttctcctccgctgagaacggagacgcggctttcaatgtgtttggtcgtcaggccgcatttggcgagggcggcgcggatttcgtattgggtaaaggaaggaaattcgctccacacttcttcgatgcacgtattgttattggtttctttcacttcctgctcgaaatagcccgtgtattgatgctcgccgcgctccaccgtgccttccagcggctggatttcaccgagcaggctttttaacagcgtcgttttcccgatgccgtttgcgccgtacagggcgactttctgtccgcgctccattctgagattgagcgggcgtgacagcggagtatcgtaaccgatgactaagtccttcgtttcaaaaatgagcttgcctgacgttctcgcaggcttgaaatggaattccggtttcggtttttcggccgccagttcgatcatatccatcttatcaagctttttctgacgggacatcgccatatttctcgtgctgacgcgggctttgttgcgggcgacgaaatctttcagctcagccacttcctgctgctgttttttgtaggcggcttcgagctgctgttttttcacttcgtagacttccataaactgatgataatcaccgacataacgcgtcagctcttggttttccacatgataaatcaaattgattacgctgtttaaaaacggaatgtcgtgagaaattaagatgaacgcattttcatattcctgcaaatagcgtttcagccattcaatatgctgttcatcaaggtagttcgtcggttcgtccaacagaagaatttccggcttttccaaaagcagtttggcgagcagcactttcgtccgctgtccgccgcttaagtcagtgacgtcgcggtctaggccgacttcctgcaggccgaggccgcgggcgatttcttcaactttgctgtcaatcacgtagaaatcattgtttgtcagggcgtcctgaatgacaccgacatcttcaagcagctgctcaagctcatcagggtccgcttcgcccattttgttgtaaatctcgttcatttcttcttccatcgcaaataagtaatggaacgcatccttcagcacgtcgcggatcgtttttcctttttcaagcacggtatgctgatcgagatagccgacacgcacgtttttcgcccattcaaccttaccctcatcaggctcaagctttccggtaataatattcataaacgttgatttaccttcgccgtttgctccgattaagccgacgtgttccccttttaaaagacggaacgatacattgttaaaaagcgcacggtcaccgaagccgtggcttaaatcttttacggataaaatactcatcattacacctctatcgttatcagacacgctttttttatcatgtgtctttctcatttatgattataaaggaggagaccgtttgttaaaaggcttggaaggaaaaagaaaattgcgtttgccgcgtgcatttgagatactatggagtagattttaagaattgaggagaacgacatgacccaaacatggccatttttacagcatacacaaccatttatcgccgaaaactgggaggcgtcaggctttcaggagccgaccgttattcaggaaaaagccgctcaggtgatcatggaagggaaagacgtcattgccgaatccccgacgggaacgggaaaaacattggcgtacacgcttccggttctggagcggatcaacccggaacagaaacatccgcaagtgatcattttagcgccgtcccgcgagcttgtgatgcagatttttcaagtgattcaggagtggaaaaaaggctccgatcttcgcgctttgtctttgatcggcggggcaaacgtgaaaaagcaggtggagaagctcaaaaataaaccgcatatcattgcaggcacaccgggcagggtgctcgaattgattcaggcgaaaaagctgaaaatgcatgaagtcaagacgatcgttcttgatgaagcggatcagctcgtgacaaaggaacaccgcgaaacgatgaaaaaaatcattaaaacgacgctgaaagaccgacagcttttaagcttttccgctacgctgcagccggagacagaagaggtgctgaatgccatcgcacatgaaccggccgttttgaaagtggcgcggaatacggcggaaaaagcgcgcgtcacgcatcaatatctcgtctgcgatcagcgggataaagtgaagctattgcaaaagctgtcacggctgaacggcatgcaggcgctcgtgtttgtcagagatatcggaaatttaagcgtctatgcggaaaaactcgcctatcatcacgtggatctcggcatcctgcacggagaagcgaaaaaaatggagcgggcaaagatattatcagcgtttgaagggggagaatttccgctgcttctggcgactgacatagcggcgcgcggacttgatatcgatgatcttccgtacgtcattcacgcagacatcccgaatgaagacggatatatccacagatccggccggacggggcgggccggtaaagaaggaaccgtactcagccttgtcacgccgatggaagaatccaaattgaaaaaaatggccaaatcactcggaattgagctgaaagaggccgtttattcaggcggaaaattatctgagaaataagaaacggagggcgggaagcccttcttttttattgtgaaataatagaaaaggttcaggcgggggcgggaagatggtttcaatagaccgatttcaaatattgaaggtacgtgagctgaaaatacttgaacactggtttaagaacgataatatcagacggagaatggatgcgatgcggccactaaatgcatggtatgcacgattgagtaaagatgaagacgatactgtcattatggcatatgacgggcagcttccggcaggaatggtctctatagagtttgtggaggaacgggcgtatatcggattgatcgtcaatcctttgtaccagcttcaagggtacggaaaacagatcttgcaaaaactgctgactgatcctgggtttaccggcgtgcgggaatgggcggcaagcatctaaaaagacaatcaaatcagtttagtctgctttcaagcagcgggattcactttggaaaatacggagcctgatgaagacggctttcttactttgattcttcgcggctgatgcgaaaaagcagaaaaggaggggacaaagccctccttttttcatcatcatgttaacctagatcactgactttgatgatctgtttgcctttgttttctcctttaaacaaaccgaggaacgcgtcaggaatatggctgaatccttccgtaatcgtttcttcataatgaagcttcccgtccttgagccattcggccaattgtttcgcgccttcggaaaagcggtcagcataatcactgacgatgaacccctgcatcagcgcttttgttttgatcagcttcggctggacgcgggggcccatgtcttcctcttcactttcggtattatatgaagagatcgctccgcataccggaatgcgggcgaattcattcagcaggtttatcaccgcatctgaaatcggtccgccgacattgtcaaaatagacatcgacgccgtcagggcatgcctgttcaagcgctttttgaatatcatccgccgttttgtaattaatggcttcatcaaattgaagctcctctttaagatacgcgattttttcgtcagaaccggcgatgccgacaacccgcgcgcctttgattttggcaatctgcccgaccgttgagccgacggcgcctgcagcccctgaaacgacgacggtttcgccttttttcggacgcccgatatcaagcaggccgaagtaagcggtcagtccggtcatccctaaaatgccgagatacgcctgggcgggtgcgatatccgtatccaacttgcggagggcggactcattgacggctgaatattcctgccatgcgagatttccgatcacaacatctccttttttcagcttatcgccgtctgtcagaacttcggcaatcactccgcctgttatggcttcatctaaagcgaacggctctacatatgattttgtatcctgcatccgtccgcgcatgtacggatcaacggacacataactcgttttcacaagcacttcgccgtctttcggttcgggaacggcaatcgtttcaaagcggaaatcgtcatggacgggaacgcctttcgggcgtcttgccaattgaatctgctgctgattattcggcatactgaatcctccttcaagataagtggttgttccaaatgtaacacgaaccatttcccgaatacaaaatcaaaccgtccgccggcaacaaaaaaagaagggccagggcccttcttttcttatatgcgtatttaaaagaataaccggtacacatcggtgtttttctcatgttccaaatattcataggcattcgtttttgaagaatgaagcatgtcagaggtaatcacgggctgaagcgcggtcagataagaacccagcttattttcaatttctgtcggcagaacggattcgatatcaccgatattgataatgatagagaaaacgaaatcgatattaatatgaaaagtatcttcagcaaaggccgtaagctcttttattccatccgggcagcgggtatgccggcggaatacctgcttcactaaatcactgacaacccaagcgttaaatcgctgttccggtgaaaagtaatgaataggaaccacctccctgcttaatcggctcatgaagatttttatttttctgataaaagttactttccctactgtaacatgtcccgccggaaaatatccaccgacaatctgcccgttttttcccggaactctctttcttttgtttgacctttggttgagcgggtaaacatccaatatacaaaaacaaaagggaggacttatcaatgaaaccggtagtaagagaatatacaaatgatcaaaaactgatgcaggacgtaaaagagcttcagcaattgggtgtcgcaaaagaagacgtatatgtgctttcacatgatgacgacagaacggaccgtctggcggataatactgatgtcaataccatcggagcgaaagaaacgggcattaaacacgcggtcggcaatatgtttaataaaaaaggcgacgagctccgcaacaaaattcacgaaatcggcttttcagaagaggaagcatcacaatttgaaaagcgcttagatgaaggaaaagttcttctgtttgtcacggataacgaaaaagtaaaatcatgggcgtaagctgaacagatcccaaggggttttcggtcccttgggatttttttgcggtttccgcaataaaaccgaaaggcacatgctgtacattttcggtgccgtttctcaactgatttgatacaatccaattgtaataaattggaacagagaatcaggaggagcacaattcatgaaaaaaatgttacttatgctggcggtttgtttatgtatgatccctgcggacgtctatgccgctgacctgggacggcagacgttaggaacaaatgacggctggggagccgcttccggcgggacaaccggcggcgcgaaagcctctttatcgaatgtctacaccgtatcaaacagacagcagctcgtttctgcattagggggaagcgccaacagcacgccgaagattatttacatacaaggcacaatcaatatgaatacggacgaccggaataaaacgctcggctttaatgattataaagatccggcatatgatctcaacgcttatctgaaggcgtacgacccggacaaatgggggaaaaaagcgccgtcaggcacccaggaagacgccagacagcgatctcaaaaaaaccagaaagcacgggtcgtgattgacattccttcaaatacgacgatcatcggttcgggttcaaatgccaaagtgacaggcggaagttttaatataaagaacggcgtcgacaatgtcatcatccgcaacattgaatttcaagacgcttacgactattttccgcaatgggacccgacggacggcagcagcggcaactggaactcggaatatgacaatatcaccattaacggcgcgacgcatatctggatcgatcattgcacctttaatgacggatcgaatcccgacagcggttttccctactattacgggagaaaatatcagcaccatgacggccagacggatatagccaacggggcgaattatattacattgtcctataataaatatcatgaccatgacaaaggctccgtcatcggaaacagcgacagcaagacgtcggatgaaggaaaactgaaggtgaccattcaccataactattaccagaacatcgtccagcgcgcaccgcgggtccggtacgggcaggttcatatttataataatttttacgcaggctctaaaagcgccgcatacccgttcagctatgcgtggggcgcaggccacgcgtcaaaaatatatgcccagaataatgtctttgaagtgccgggactggctgctgataaagtcatcagcgtcttcagcggcggaaaagcacttcatgaagacggcactcttttaaacggcgccgcaattaacgcgtcagctgccaacggattaagtcagtccgtcggctggacaccgtcattgcacggttccatcggctcatcatcaaatgtaaaatcagatgttatatctaaagccgggtcgggtatattaaaataataaacaagaagcacaaaggaaaatattcctttgtgttttttaattaacaaaaacgtttattaacttagttaagtagtaaaatgggatagggggatggaagacaacaaaataggaggagacctgtaatggcttcagaaaaagacgcaaaaaaacagcaggcagtaaaaatcattcctttgcttattactgttgctgtgggattaatcatttggtttattcccgcgccgtccggacttgaacctaaagcatggcatttgttcgctatttttgtcgcaacaattatcggctttatctccaagcccttgccaatgggcgcaattgcaatttttgcattggcagtcaccgcgttaacgggaacgctatctattgaaaatacgttaagcggatttggaaacaagacaatctggctgattgtcatcgccttttttatttcccggggatttatcaaaaccgggcttggcgccaggatttcttacgtattcgtacaacggttcgggaagaaaacactcggcctttcttattcactgctgttcagtgatttaattttatcacctgccattccgagcaacacggcacgggcgggcggcattatttttcctattatcagatcattatccgaaactttcggatcaacgccggcagacggaacagagcggaaaatcggcgctttcttattaaaaaccggttttcaaggaaacttgattacgtctgcgatgtttttgacggcaatggcggcgaatccgctgatcgccaagctggcccacgatgtcgcaggggtggacatcacatggacaagctgggcaatcgcggccattgtaccgggattggcgagcttaatcattacgccgctcgtcatttataagctgtatccgccggaaattaaagaaacaccggacgcggctaaaatcgcaacggaaaaattgaaagaaatgggtccgtttaaaaaatccgaactctccatggttatcgtctttttattggtgcttgcgctgtggattttcggaggaagcttaaatatcgacgcaacgacgacggccctgatcggattatccgttttgcttttgtcacaggtattaacatgggaggacatcaaaaaagaacaaggtgcatgggatacgctgacttggttcgcggcgcttgtgatgctggcgaatttcctgaatgagctcggcatggtgtcttggttcagcaatatgatgaaatcatctgtttccggtttttcatggattgtggcatttatgattctgattgtcgtgtattattacacgcattacttctttgcgagcgcaaccgcgcatatcagcgccatgtatgcggcatttctcgccgtcatcgtggcggcaggcgctccgccgctgttggcggcgctcagcctggcgtttttcagcaaccttttcggttcgacgacgcattacggctcaggagcggctccggtctttttcggagcgggttatatctcgcaaagcaaatggtggtccatcggctttatcctgtcaatcgtccatattgtgacatggcttgtgatcggcggattatggtggaaagtattagggttatggtagaagaaaaaaggcagactcaggtctgccttttttttatttctgtaaggaatgggaagggcctgcacacgctgacttcagtgcgaatagaatattgccggggtgatattatgagcagcggccgtaatcaatacatgatattgaaacagaaaccttacaaatatatgagcagacatatgaaacgccggtatgaacaattaccatgtgaacttgaaagtccggaaacagggacggaaaaacggtttccgtcttcaaatgaaaatcgatctgccttgtgcgtacccgggctgcgaggtcccgaaggcaaaagaggacccgccggctcccgcggtccgcaaggggaggcgggtccgccgggtccgcccggtccgcccggtcccccggggcctgaggggccgccgggagcggttcctgcggtagcttttcaaaatacagcagacctaatgacgcttccgttagaaggaacaccgataaacgtgttaagcgcagtgatagctgcgccgacagatcaattggtgaaaacggatgccgtcatacaagtaaatgtggaattagatccgcttgcgtctcatttctcattggtcttagctgtcgagctgcaaagaaatggcgtaacgatacaaacacagagacaagagcggaacctcttttcttcaggcggacaaatcataggaattccttttacgtacatcgacgaaatgaaggcggatgaaacagccgcgtatcagctctatttatccgtcctttcttcgaactacgtaacacaagtcgcagcagcaaaccgctccctcattgcgacgggattccccattcaaggatcggattaaggtgatgaaaagaaatcaccttttttatttaggttgtcaaaacacagcccgtattaatatgctgtcttaataagtaagacggtcaacaacgggaaggagagggaaaaagattgaatgaataatccgattataaacggaagctttgaaaccggcacattagcggggtggagttcggcaaatacccagattaacagtttgtttgcacattcagggagatattctgcgcaatttattggagctcagccatatgcttacctcagtcaaatcgttcccatttcagccaagtcagtgactctattcgtatcactcgcaacgctcggaaatgatccaagtccccaagtcactctccagatcatctatgtcagcgcagcaggtgaacaaatcagttccattcaagaaaatattacacccggaaatttgccgaacgtgctctttcacacatggtctgaaatctataaaacaagcagtgtgccttctggcgcggcctctgccgtcattgtattaagtaaagtttcttccggcacggttttaatagacgatgtttcattggcgcaaaccgggggtgaacctggcgtaacaggaattacaggtcccactggagtgacgggcccaacaggagtgaccggcgcaagaggagcgacgggagtaactggtgcaaccggggcaagaggagcgacgggtgtaaccggtccaaacggagtaactggtccgacaggagtaactggagcaaccggctcgactggtgtaacaggagcgaccggaaccacgggctcaaccggagtgactggagtaacgggagcaactggttcaaccggttcaaccggagcgactggggtaacgggtgtaactgggggaacgggaacaaccggcccaactggagcaacggggataacaggagcaacaggcccatccggagcaacggggataaccggcgcgaccggtataacaggtccaactggatcgacaggagaaaccggcccaaccggagtaacaggggcgacaggagaaaccggtccaaccggagcaactggttcaacgggagtaactggagcaacaggcccaacaggaacaaccggtccaactggagtaacaggagcaacaggctcgactggcataacgggaacaaccggcccaactggtgaaaccggagaaaccggggcgacgggagtaaccggatcaacaggagtaacaggattaaccggtgcaacgggatcgacaggctcgactggggtaacaggatcaaccggtgcaacgggagaaactggttcaacaggagtaactggctcaaccggtgtaacgggagtaacaggagcgaccggagtaacaggggtaacgggatcgacaggcccaaccggcccaaccggcccaacaggggcaacgggtgtaactgggggaacgggaccaacaggttcaaccggagaaactggtgtgactggcccgatcggggtcacgggatcgacaggagcaaccggggcgacggggataaccggctcaaccggagtaacaggtccaacgggggaaacaggcgcgactggctcaaccggtccaaccggctcaaccggtccaataggagttactggcgcaaccggagaaactggcccaacaggagtgactggtgcaacaggctcaaccggagaaaccggctcaactggtgtaactggttcaacaggagaaaccggtgcaactggtgtaactggttcaacaggagaaactggagcgacgggagtaaccggatcgactggcgcaacgggatcaactggagtaacaggatcaacgggagaaacgggcccaactggagtaactgggacaacgggagaaaccggagcaacaggatcgactgggttaactggtgtaaccggatcaacaggctcaactggttcaacgggagtgacaggttcaaccggatcaacaggcgcgactggctcaacaggagcaaccggcccaaccggagtaacgggatcaacaggagcaaccgggtcaactggagtaacaggtacaacaggcctaacgggtgtaacgggtccaacaggagtaactgggacaacggggataaccggatcgaccggggtaacgggaccaaccggaccgacaggatcaaccggctcaactggtgcgacgggattaactggagaaaccggcgcaaccgggggaacaggttcaactggttcaacaggagcaacgggatcaaccggtccaaccgggccaacagggtcgacaggttcaactggagttactggtgcagcaggatcaactggacccacgggagagatcggtccaacgggatcgccaggctcaaccggagaaaccggtgcaacgggagctactggagtaaccggcccaacaggggcaacgggtgtaacgggagcgaccggagtaacaggggtaacgggatctacaggctcaaccggcccaaccggcccaacaggggcaatgggtgtaactggagaaatcggcgcaactggagagaccggtccaactggatctacaggttcaaccggaataacaggggcaacgggttcaaccggaccgacgggctcaacgggagaaaccggtgcaaccggtgcaacgggagtaacaggagaaacaggcgcgactggctcatcaggctcaactggagtaacaggagcaacgggatcaaccggcccaaccggcccaaccggaataacaggtccaaccgggggaacagggtcgacaggtccaaccgggggaacagggtcgacaggtccaaccgggggaacagggtcgacaggtccaaccgggggaacagggtcgacaggagaaaccggcccaactggctcgaccggggatactggagctactggagtaactggagctactggagtaactggtgcaacaggagaaaccggagcgactggtgtaacaggcccaactggttcaaccggagaaaccggggcgacgggagtaaccggatcaacaggagtaacaggatcaaccggtgcaacgggagaaactggcccaacaggagtaactggctcaaccggcccaaccggtgtaacgggagtaacaggagcgaccggagtaacaggggcaacgggtgtaactgggggaacgggcccaaccggaccgacaggagaaaccggcgcaaccgggggaacaggttcaactggttcaacaggagcaacgggagtaacaggagcaacgggatcaaccggtccaaccggtccaaccgggtcgacaggttcaactggagttactggtgcagcaggatcaactggacccacgggagagatcggtccaactggatcgccaggctcaaccggagaaaccggtgcaacgggagcgactggggtaactggtataaccgggggaacgggaacaaccggcccaaccggagcaacgggggtaacaggcccaactggtgaaacgggtgtaacgggagtaacaggatcaaccggtgcaacgggagaaactggcccaacaggagtaactggctcaaccggcccaaccggtgtaacgggagtaacaggagcgaccggagtaacaggggtaacgggatcgaccggcccaaccggaccaagcggcccaaccggcgcaacaggggcaacgggtgtaactgggggaacgggcccaaccggaccgacaggagcagccggctcaaccggctcaactggtgcgacgggaataactggagaaacaggcgcaaccgggggaacaggttcaactggtttaacaggagcaacgggaccaaccggagtgactggagcaacaggagccaccggtgcgacggggataaccggctcaaccggagtaacaggtccaacgggagaaaccggtgcaactggagtaactggagcaaccggggaaactggctcgaccggggataccggagctactggagtaaccggcccaacaggggcaacgggggtaactggagagaccggtccaatcggagcaacgggttcaaccggagaaactggttcaacaggaacaaccggggtgacgggagtaaccggatcaacaggagtaacaggttcaaccggtgcaacgggatcgacaggagcgactggggtaactgggacaacaggagtaaccggtgcaacgggagaaacgggaccaaccggagccacgggagtaactggttcaactggaataaccggatcgaccggtccaaccggtccaaccggcccaacaggtgtaacaggagaaaccggagtaactgggacaacgggagaaaccggtgcaactggagtgactggagcaacggggataacaggagcaacaggtgcgacgagcccaaccggtgtgactggaccaacaggggttactggctcaacaggagaaaccggagccacgggctcaactggagtaactggagcgaccggtgtaactgggtcaacaggaataaccggaccgactggctcaacgggagaaaccggctcaaccggtgcaacgggaataactggagaaaccggagcaaccggatcaactggcccaaccggagcaacaggtgcaaccggagtaacgggatcaacaggagcaaccgggtcaactggagtaacaggtacaacaggcctaacgggtgtaacgggtccaacaggagtgactgggacaacggggataaccggagcgactggggtaacgggtgtaaccgggggaacgggcccaaccggaccgacaggagcagccggctcaaccggctcaactggtgcgacgggaataactggagaaacaggcgcaaccgggggaacaggttcaactggtttaacaggagcaacgggaccaaccggagtgactggagcaacaggagccaccggagtaacgggtctaactggtgtaacgggatcgacaggagcgactggggtaacgggagcaaccggccccaccggagtaacgggtctaactggtgtaacgggatcgacaggagcgactggggtaacgggagcaaccggccccaccggagtaacgggtctaactggtgtaacgggatcgacaggagcgactggggtaacgggagtaaccggctcaactggtgcgacgggattaactggagaaacaggcgccacaggatcgacaggcccaaccggcgcaacagggccaacaggtttaacaggatcaacaggagcaaccggaaccacgggctcaactggagtaacaggagcgacaggagaaaccggcgcaacaggggcaacgggggtaactggagaaatcggaccaactggctcaaccggtgcaactggctcaactggctcaactggctcaactggctcaaccggcgcaaccggagtaacgggtccaactggcgcgactggctcaaccggcgcaaccggagtaacgggtccaactggcgcgactggctcaacaggagaaaccggtgcaactggatcgactggcgcaaccggtccaacgggtgtgactggagcaacgggagaaaccggctcaactggcgcaacgggtgcatccggggcgaccggcgcaacgggaataactggagaaaccggagcaacaggatcgactggggtaactggtgtaaccggagcaacaggctcaactggttcaacgggagtgacaggagcaactggttcaacgggagtgacaggagcaactggttcaacgggagtgacaggagcaactggggcaacgggggtaactggagcgaccggtccaaccggatcaactggttcaacgggagtaactggagcaaccggatcaactggttcaataggagaaaccggagcgaccggtgtaacagggtcaacaggaataaccggtgtaactggctcaaccggcccaactggtgaaacaggagcgacgggagtaacaggcccaacaggtgtaacaggagaaaccggaaccacgggatcaaccggagtaactgggacaacgggagaaaccggtgcaactggagtgactggagcaacggggataacaggagcaacaggcgcgacgggcccaaccggtgtgactggaccaacaggagaaaccggttcaacgggtgtgactggagccacaggagcaacaggatcgactggggtaactggtgtaaccggatcaacaggctcaaccggagtaacaggggcgacaggagtaacaggggcgacaggagaaaccggagcgactggcccaaccggagcaactggcccaaccggagcaactggggcaacgggggtaactggagcgaccggtccaaccggggtaactgggacaacgggagaaaccggtgcaacaggagtgactggagcaacggggataaccggagcaacaggcgcgacgggcccaaccggtgtgactggaccaacaggagaaaccggagcaacgggctcaactggtgtaaccggtgtgactggatcaacagggttactggctcaaccggagaaaccggttcaacgggtgtgactggagcaacgggtgtgactggagccacaggagtaacgggatcaacaggagccactggagtgactggggcaacggggataaccggagcgactggcgcaacaggagtaacaggttcaaccggagaaacgggtccaacaggagtaacaggggccactggagaaactggcccaacaggaatcacgggtccaacaggagccacaggagtaacgggatcaacaggagccactggagtgactggggcaacggggataaccggagcgactggcgcaacaggagtaacaggttcaaccggagaaacgggtccaacaggtgtaacaggactaactggagcaacgggagtaacaggcccaaccggtccaacgggtgtgactggagcaacgggtgtaactggagcaacgggtgtaactggagcaacgggtgtaactggagcaacgggtgtaactggagcaacgggtgtaactggagcaacgggtgtaactggagcaacgggtgtaactggagcaacgggtgtaactggagcaacgggtgtaactggagcaacgggtgtaactggagcaacgggtgtaactggagcaacgggtgtgactggagcaacaggagccactggagcaactggagtaacaggagtaactggagtaacaggagtaacgggtgcaaccggagtaacaggcccaaccggtccaacgggtgtgactggagcaacgggtgtgacaggagcaactggagcaactggagcaacgggagtaacaggagcaaccggagtaacgggagtaacaggagcaaccggagtaacgggagtaacgggagcaaccggagtaacaggagcaacgggagtaacaggagtaacgggatcaaccggagtaaccggggtgactggcccaactggagtaacgggcccaaccggaccaaccggcgccacaggcagtacaccaaccttgctcttcacaagaaccaacgggccgctcactgtttatccgccgttaaatacagaagttcccgttgctacgctggcaatcccagttaatgctttgcagaatgtaaagctggattatgcactcagtgccgcgttaacaactgcagcgaattcaaactttgtttttgaagtgagattatataggggagcagtgcaaattcatacaagaactctgtcgcgaaccagtactctcgcagctacggatagtttttcgattgctgatacaacagtggatactgcgccgaccgcaggaacgaacacttaccagctcagggttattttcacaactgctaataatttaacgacagcaactgcactcaatatcgattttaacagcataagttttccgacaacctaatacaacagcagactgatattttaaagatgaaagacctgacttatgcacagttaggtcttttttctgtaaaatgctgtgcatgatgcagtcttaacgaacatttgaaaaattgcccaatagaagtggggttttgccacaccttttttctctgtggaaatattatgaaaatagaggtggtgtaatgagaaaaggagatacttggtataacagatacgattcttgggattacgactgccgaaattgtaatgagtgttgctgtcattttcaacataaaagaagaaatcaaaggcgcagttatcaaaatcgggcacattgctgtgaaggattctgttgcgaacccccttgctgtcatgaaagatggtgtccatgctgtcatccaaatcattttcacgtaagaggattcaccggagcaacggggtgcaccggagcaacaggactgaccggagcaacaggactgaccggagcaacaggactgaccggagcaacagggctgactggagcaacggggttcactggagcaacagggctgactggagcaacggggttcactggagcaacagggctgactggagcaacggggttcactggagcaacaggactgaccggagcaacgggctcgaccgggaataccggagcgactggggtaaccggtgccactggagtcactggagatcccggcgccacgggagtaacgggagccaccgggataacaggcgctaccggggtaaccggagcgacaggagtaacgggagcgacaggaataacaggagccaccggggtaacaggcgtaaccggagcgattggagtaacgggagccactggagtaaccggggatactggagctaccgggataacgggcacgaccggagtaacgggagcgacaggaataacaggagccaccggggtaacaggcgtaaccggagcgattggagtaacgggagccactgggatcaccggagctaccggagtaactggggtaaccggagtaacaggagccaccggggctactggagccactgggataactggagccactgggataacaggagcgacaggagtaacgggagccaccggggtaaccggagcgactggagtaacgggggcaaccggagcgactggagtaacgggggcaaccggggctactggagtaactggggtaaccggagtgaccggagtaacaggcgcaaccggagtaaccggggatactggcgctacaggagccactgggatcaccggagcgactggagtaactggggtaaccggatcgaccggagtaacgggagtaacaggagtaacaggagtaacgggagtaacgggagtaacaggagcgacaggaataacgggagctaccggggtaacaggcgctaccggagtaacaggagcgacaggaataacaggtgcaactgggatcaccggagcgactggagtaactgggatcaccggagcgactggagtaactggggtaaccggatcgaccggagtaacgggagcaaccggagcaaccggggctactggagcaacaggcgccaccgggatcaccggagtaaccggagtaacaggcgctactggagcaacaggcgccaccgggatcaccggagcaggcgcgatcattccttacgcttcaggtcttcccactgccgtgacgaccattgccggcggattaatcggaacggtgagccttgtcgggttcggcaattctgtgacgggcgtcaatgtcggagggggaggtgcaattgatcttaccggggctggaggaactctgctgaactttgctttttctgctccgagaagcggaaccattacatcaattgccgcctatttcagtacaaccgcagcattgtcgcttgtcggctcgactgttacgataaccgcacaactatacagttctactgtgccgaacaatacgttcacgccgatccccggagcatccgtcactttagctcctcccctcaccggcgtattgtcaatcggcagcatcagcaacggaatcacgacagggctgaacattgcggtaactcctcaaacccggctgttaatggtattctctgccactgcgacaggcctttcgcttattaatacagtggcgggatatgcaagcgcgggggttacgatttcttaagtgagaacggccagactggtgcggatcatctaagctaagcttggagaagatatcattttttcttcaagcttttttgtttttacgtctttctgtaaaggctgacgggaatttcccgacagtcggcagaagtatttacatgccttttgaagttaatcagtatcttaatgaagacgttttcagtgagttcgaatcatccgttgtgccgggagtgtgaatcatcatcgaaacagcggtgccctcatccggggtgctggtgatcgtcaattcgcttccgcaaaaatgcttcagccgccgattgatatttttcaggccgacactgcgattaacatcagaagacaaaatatctttctgtatgtccggcatgatgccggttccattatcctccactttgataagatacgtgttttcgccttgttttttcgctgtcagctttatccgtccgccgcctcttttcttactgatcccgtgatgaacggcgttttccaccaatggctgtatcattaaaggcggaagggggaagtcaatgtcctgttcaatatcaaaaaggatatcaagccgtttgccgaagcgtgttttttctatagaaagatatgacgtaatgatagaaagttcgtttctgaatgagctgatgtccgaagtgttttgaaaatcaaaactcatccttaaatagtttgtaaatgcagcagtggtttcccttgctttttcaatatccaaatggctgagcgcgataatcgtatttaatacattgtaaagaaaatgaggcttaatctgcgactgaagaaatgccatttctaaatttgtggcttggtgagccgtatgcttcattaaaattaaatttttaatacgcgcggtgaattcagagtaatgataaggcttttgtaaaatgtcgtttgctccggcatgaaacgccttgtatttgtcatggctgataatggctgccgtaacgataagaaccggcagatcgaccatgctgaacctttcgcggatgtttgtgcagacttcaaaacccgtcatgtcaggcatcatcaagtctaatatgaccaagtcaagcttcgaggaagagacagcttgaagcgcctcttttccgctttttactgcgattacgttataaggaacaccttccagcatatcaattaaaattttcaaactctcgatattatcgtcgacaatcagaatcgtcggagcatcgattttctctgagtgataaggcgtgaccaacgaaatatccggtattctctgtccgggctgtgatttaggaagttcggtctttgcttccggtaaagaaacaatttgagcggcgggtaacgtaaaatgaaaggctgatccttgcgccgccgctgactccgcccagatgtccccgttttggagcttgacgagctgtttcacaatacttaaacctaaacccgttccatcttcttccttccctcccgcttgctgaaaagaatcaaaaatggtttcaagatcagcctcaggaatgccgctgccggaatcggtcacggttatttgaatcattttgtcattcaggtttgcggcggaaagaataatgttcccctcggatgtgtacttgattgcattttcaataagattggttaagatttgccggaatcggttttcatctgcaagcaccaaagggagatcgtccggcacatgattaagaatcgcgagttttttatgtttggataaaagccggtagaagttcatctcactgcatatgacggcatgcacatcgacgggaaccggacgaatctgcagcatcccctgcttcattttttccaaatcaagaatatcatttacgagatcggaaagtctgtagcccatacggatgatcagctgcatattttctttctcttcctctatcgtcttcttttttctgccggctacaagggtttggcatatattaataatgctgttcagcggcgtcttgaattcgtgtgaagttttggcgataaattcatctttcagttggtccattttgactaatttccgtgagaggacttcattgtcccggaaagctccggcgaattgctgcgccatcaggagaaccaccgccaataaagcgatgactgtcggcaatgaatagatcgaattaaaagaaaaagctgttttgccgctgtaagctgaaatggtcgtaagaatcacaaaagcgctcatcgagacggatgcgagtgtaaggtacgtgcttccttttatttttcttatggcggcaatcgtaaaaatatatgtaatataaaacagagtcgtaacggccagcacagaatgtaaaatgtatgagaggtgatcaatgaaacttccggacataaaatcagtgatcaagatgatcccggataaagcggttaaaatggtgatcgtcgtttttgaaacaatttctctgtatgcataaaagagataaagaaaaaccgccatgctgacaagcacggttgagatgatacgcaaggaattcagcaatgaaaatgaaatagacggaaagaggagaaagataattctttctttcccgatcataagaataatggctgaaaaaagcagacacatcacggaaaagaacaataaatgtttatcctttgtccgttgcagaaaaaagccgagaaaatataaaccggtaatgaaaaaagccgtaatcataatggaatcattaaaaaaggaaatttgattctcgcgtataatttgttcttgagtcccaaacgttatcggttttgcgatcccccagccgggaacttttccgaaattcgaaaaatgcaggacaagttcattgtcacccttgcgaagcctgaaaaagctgctgtacggtttgttctgcgccttaaaatcagctttttctgaaggattgccgctctgtccgattacttttccattaagataaaggcggtttgaactgtagatataagatgtgctgatccccaaaacctgattgtcttcatttgatcggattgtcagtttgtacgttccgtaatccacgtcggccgtttttccgaacagcttcacattgacagggacatcaacgagtacgggattttttccttttgctgaatgaagcgcctgcggtgacagcatctgatttggatatagaatccatttcccgttcagctggacatttccatccttttgaaaatcccaattttccagattgatcacgccctgttccgcttgagggagggatgatcctgaaaaatgatccatggccataaaaatcataaagaaagcagcatagccgcaaataatcgtaatcgaaataaatttttctttcacatcattactcctttatcccattcaggggcattctattatcctatttaatgtataaatattgtaatcacaaacgttataatacaacaagagaaagaaaaagaatccaactatatagggcattgggcatggtataattgaaattattttcagatatatctatattgacgggtgggatgcggtttgaaagcgttaattgtggatgatgaggaactggcattgcttcattttaatcgtatgcttgagcggacaaacgcctttcaatctattataacgtttcaagatccggcggaagttctggagcattcggaactttcagcagctgatgcggtgtttcttgacattgaaatgcccgggataaacggtattgagcttgctgaatcgattcaggaggtcaatgaaaatatccaagttatttttatcaccgcttataatgaattcgcgatcaaagcgtttgaattgaatgctgtcgattatctattaaaaccggttgacaatgcccggctgctgacaactgttgagcggatccgaatgaataaaaaactcaggtcggcggacgggaataccgggacggattatgttatacaatgttttgggaacctggacttttatcaatcggtaaatggtgtcaaaacatacataacagtcaagtggagaacatccaaagcccgtgaactgtatgcatttttacttcttaatcaagggcgcacggtcagtaaagacatgctaatggagatgttttggcctgcttatgatatatcaaaagcaagcacccagctctactcgacaatatatcagatacggaaattaatcggtaagctgcccttcagccaatcaatagaaaatactgatataggatacattctccggctttccggggtaaagattgatacagttgaatgggaaaaaacattcaaagaggctcctccgctcagcgcagctgcactaacccggcacatgaacatggtcatgtcatatgagaaccattatctcatggagaatggctatctgtgggcagagccggaaaaagcgcgtcttgcccatctgtggctcagcaaagcgtacgaactgattggttttctcatccaagagaagaacgatcgtcaagcgatggacgtttgcctgcaggttgagaaaatagagcccggtgacgataaaattatacaatacaaactgcagttatttaataaactgggaaaggtagaagaggcgataaaggaatacgaacgatataaacaattaaaagataaaatcaattgacgattgaatgaccggaccggctgatgccggtctttttttgtgcgctatttctgaaatgatcccatgtacagaatttgtataggccgatttcatacaatgtagtttggttcggataaggagaatcccatgcttaccggcttgttcgaacgtaagtctatataaaaggggaggaataagacattgggagtgaggaacttttcgttcagcccgaaaaaaagcaaaaggctgagggcggcattgatttcatgcttcacgctgtttttcatcttcagccaagttgtcagctttactccgatcgcagccgcttccggatcacaacatagcgagagcgggttctttgattcagttgcagtcaaagacggcagacagcagaccgttgacggatcaaaagccggtgaaccggctttaacaccgggagataaagtgacactgacatacgaatggtcactaaaacacaaagaagatgcaagtgaccggaatatcaccgtaaagattccggaaagttttacattagataatgatgccgaaggtgagctgaaatcagctgatcgggtgatcggtatatataaagctgaagcaaacagaagcacgctggaagtgaaagtgaacgatgctgaagcggatgccggggatgccaaaggctccattacactgtcggcgaagtttactcccgacataacagatgagacgaaaatggcaaaagctctttttcaactggatgccggcaagacccagcaagtgttaatacctgtgaagaaagacggaacaacggattccgatacagaaaaaaacacctcttcaacacctgctgaacctcaggataagacagagaaaaaatcagcatctgcagacggcggggataaagcagaacaggcaacgaaatcaaaaccttctgctaaacgcagtcaatcaaaaatggtgattacaagcaaatctgccgctaaaagccttcaatcaggcggaaaccggattacgcaaaatattttaactgatgtgaaattgacggatgaaaaaggaaaaccatatgacaaaaacaaccctgcgaatacgaactctccggcgaatatcaccatccaatgggcgattccgaatgagctggggaaaacaataaacgacggtgatcgatatgaatttgacctgcctaaagaatttattatgcataatgacattacgaaccagccattgaccgacggcgatagtacgtacggaactttttccattaatacgagcggccatgtcatcatgacgtttaacggcgaggtaaaagaagattctaacgtcaaggggtcattgtatgtaaacacccaattcaatcagaaagaaataaaaggatcaaccacacaaaagattaagtttccggttaactctgatacgccggacgtaacggtttattttaaaccgaatgtcaataaaaccattgagaaatcagggtcattggataaaggcattaatcccggaaaggtaacgtggacggttgaccttaataaaaaggaagaagaagttaaaaatgcgaaattgactgaaagccttccggacgaattgactttccgctctgtgaaagtgtatgaacttgatgtgaatattgacggctcggtgagtcagggaaatgagataacttcaggttataccgttggcgaaaacggtaatgtcaccttcgccgggacaattgattcagcctaccggctcatatatgacacggaaattaaagatgaggcaaagccgggtaaaggcggaaacatcacgctgacaaacaaggcggcattcagcggagacaatgcggagccgatttctgcggaagcttccgtaacagcgggttacggaaaaatgatagaaaaatcttcgacaggttataaaggagaaacccaaacgttcagctgggctgttatgtacaactacggtgagaaaaagattgatcaatccaaagccggcattaaggatacgttcggatcagacgatctgcatctagttcccggatcattgaaagtccttccgattacattcagccagaacggcagcgaacaagagggcgccccattaaaagagggtgatgattatacgctgactgataacgggaacggctttgaaataaaattcaagcaaactgtcacaggagcatataagatcatttatcaatctcaagtcaacgatggggtcattattgacagtcctgtcaaatacaccaatacagcaatgacagatacgggggactcaaaggaaactccgggaaccgccattcagcagaatctgatcaaacattattcaaacgcagactatgagaagaagacggttgattggacaatcacagttaacaaaaacggttacacaatgaaagactggacgctggatgatcaattcaccagcggaggcctggcgctcattgacgattcatttaacatgcaagacacgactgaaaacaaaacgctgaaagaaggaacggattatacattaacaaaaaaacccggaaatcaaggctttacaatagcattgatcggggactacgcagaaacaaacagtcagtttaagatcacgtataagacaaaattcaacgctgacttttcaaacgaaacgattaaaaatacggcggagtcgacatggaccgataaaaacggcaacaaacgcacaaataaggaatcgagcggcttcacaccgaacaatcagacgtcccataacggattcaaaaacggctcatacaacgccgtttcaaaagaaatcacatggaaagtcggcatcaattacaatggcgaaccttcaaaacatccttatataaaagatacgatcacagatggtcagcaatttttgcatgggtcggttgctgttaaaacgtataccatcagcaaaaacggctccatcactgaaggagaggcgctggatccttcaaaatatgaaatagaagagccgtcagacggcaacaaaaatacgttaaccgtacatctcaaaacagatgacgctgtaccatacctgattgaatttaaaacgtcattaaaaggccaggtcattaaacagaatcaatacacaaacaaagcagagtactttaataatgaccatgcagaccgaacgctgacgggttcagtttccgtcgcaaacggaggaaacctgatttctaaaggcggcaaacagaacggaaacaatatcgattggaacatcaatgtcaatgccagccaatcgacactggatgacgtaaaagtcaaagacacaccggatgagaatcaaataatagatgaagattcttttaaagtatatcaagcaaaatataatgagaacggcgttatgaaagacagcagcggaaatcttattccgggtgatgtgcagcttgagaaagataaggactataaattagatatgaaaactgacaatgccaccggtgaacaatcatttgcccttacctttacaggcggctataaacaaatcgaccgtgcgtatgtcatacaatatcgttctctcattaatatttccggcagcagcggtcaggtcaacaacaaagtgtcgatatcagggacgaatgttgaggagcagacccaagagaacaacagctcagtgtttgtcgctatttcaagcggcggcggctcagggtcaggggagaagggaagcctgacgatatctaaaacaggatcagacggaacatctctttcaggagcagactttcaattatggtctaaagacggcaagcagctgctgcgtacgggcacaacagacgatgccggtaaacttacgtttgggaatatccgttacggaacctatgtactgaaagaaataaaagcgccggacggctacaccatcagcgatgcttatgtaaacggggtctccgttacgattgacggcaaatcctccgcagcaggagcactctataaagtcataaatcaaaaaaataaggtgacgcttatcaaaaaagacgaaaacaataatcctttggccggtgctgtatttaagcttgagaaaaaatcaagcgacggtacctatactctgataaaaaataatattgaaagcgataaaaatgggaaagttgagatcaacggtttgcccgccggatactaccggctgatggagacgaaagccccatcagggtttatcgtaaacacaaaagccattcacttctcaatcgcaaagaacgaaaagaatcaagtacctgatgttgaattgggatcaatggtgaattataaaggaaaagccgctttaacgaagaaagatgcagacggcgggaaccttgaaggcgcagttttcaaaatcgtcgatagtgatggaaaaatagttcaggacgatctggtttcagataaggacggaaaagtagaaacatccggccttgccccgggtcattacgccttcatcgaaacgaaagcgcctgacggctatgtgttaaatacggagaaagtggagtttaccatctcagaaacagcggaaggaaagccggagtcaactgacgcaggaacggccgtcaactataaaggctctgtgttgctgacgaaggaagatgcggaaggccgaaaccttgaaggtgcagttttcaaaatcgtcgatagtgatggaaaaatagttcaggacgatctggtttcagataaggacggaaaagtagaaacatccggccttgccccgggtcattacgccttcatcgaaacgaaagcgcctgacggctatgtgttaaatacgaagaaagtggagtttaccatctcagaaacagcggaaggaaagccggagtcaactgacgcaggaacggccgtcaactataaaggctctgtccggctgacgaaggaagatgcggaaggccgaaaccttgaaggtgcagtcttcaaaatcgtcgaccgtgatggaaaaacggttcaggacgatctggtttcagataaagacggaaaagtagaaacatccggccttgcacccggtcattacgcattcattgaaacgaaagcgcctgacggttatgtgttaaatacggagaaaaaagagtttaccatctcagaaacagcggaaggaaagccgaagccgtctgagaccggcacctttgtcaactataaaggctctgtccagctggttaagaaggatcaagacggaaacgttttagacggtgcagtatttaaaatcattgacagtgatggaaaaaccgtaagagaagatctgatgacaaaagaaggcggcaaaattgacgccggcggtttggcgcccggaaactatcaatttgttgaaacaaaagcgccggatggttatctgctgtcaacaacccctgtgcggtttacgattaaggctgagaacagcggaaaaccggatcaggctgccctgactgcagttaacatcaagaacagtgttgttcttacaaaattggatcaaggtgacaaacggaaagtcctgcaaggtgcgaagtttaatctgacagatgcaaacggcaaagtgctgagagaaggtctgacgacagatgagcacggacagattgttgtacggggactgaaagcaggcgaatatcaatttatcgaaacaaaagcgcctgaactttacagtttggatcaaacgccaatttcattcaagatcacaaataccgacataaaaccagtcgaaatcagtgcggagaatacactgacgccgggtgatgtaacactgacaaaagtggatcatgacgataaaaataaggtgctggaaggtgctgaattcaagataacggattctgccggacatccggtaaacaccggcggcagcaaagaacggccggcggtatggaagacggatcaaaagggccggtttacggtgaaaggattagcgcccgggcagtatcgatttatcgaaacaaaagcgcctgacggctatcagctgaacgaaaaaccaattgaattcacaattgaaaaaggacaatcaaaagctgttgaggtcgtcgtttctaataagaaattaaaaaatcccgcacctgggaaagacacaccgaatcatcaaacgaatcaaggcgggcatcaccctgataccaatagtaaaaccaatcacccggatacaggcaaaaatctgccgaaaaccggtgatacggacggtatgatgccggtcacggccggtattctgctgctattagccggcggagccgcggctgttgtatcaagaaagaagaaagcaaggaatagatagacgtaatcgcacctgatcatgtaagaatcgatcaggtgcttttttaaaaagagaatcatttctcaccaaatactcaccgcatgacgtacaagaaaggaattttcttcatggttaaaaaaatgatcattgccgttcttattttgtccgggctgcttctcatttcctctcctctcatgaaaggctgtttgattgcgtacctcagtaaaagccaaattgaatcggaattgaccgcagaacaagcgcggaaaaataacatgaaaaaagcggactatgaatttgaatccattcatccgcccggtttcagggaaacagttcagtcaagttttaatcgcaaaccgaaaccgataatcggacggataaccatcagcagcatcgatttagaccttccgattttaaaaggcacaaccaatgaaaacctgctgatcggcgcggcaactatgcgtccggatcagaaaatgggcgagggaaactacccgttggcaggccaccatctgaagcaggagaacctattgttcggccctcttttacacataaaaaaaggtgcgcaaatcgtgattaccgactttagaaaagactatatttattctgtaacatcaaaaaccatgatttcagaaatagaagcaaacgcaattcaggagacaaaagataaagagattacattaatcacatgcgacaaggcggtaagaaccgaaggacgcctggccgtcaaaggaaaattgattgatatttccggtcattcaaatgtatctcagccatcatagagaaacactttgtcaactgaatatacgtccgttgtgaaacatcccgagactggctcctgtcagtctttttttgcgcagcgattataaaaagttcatccttcttatctctcttgagggaaattataccagactgcactttttgaaagaaatgacaagagaaaaagatcgcgaaaattctcaaaaatgagaaatgaagatttaaaaaatggtatgattttaggaggaaaggacggctggtgctgtgttggaagcgaagcggttttatgtctctctgcaaatgaaaatcgccggattaattacggctttattaatacttgtcatcggaacgctcacggttatatttgcctttcagcaattaaaggaagggcagaagcaggctgaacagctggcggtgcaaacggcaaaaaccatttcatatatgcctcccgtaaaagaggcgttccggcttgcggatcaagaggcttttacaaagttagacgtcattgaacaaatgaaagaacaggcaggcgcgcacgccgtctacatcactgatcaaaaagggcatgttgcatttcattcggcccgaagcagtattccgaaagaaaatcaaaatctgcaaaataaaaccgtcatgttcggcgggtctccggtttccgacggaatgaaggccgtccggggaagcgccccggttattttggaggaaaaaaatcataacgaagtcgtcggaacggtgacagtcgaatttctacaagatgagatagaaaaagatatgaaggcgcatttgcggcatttaggctattttgcatgtttggtgtttcttatcggcatcgggggagcggcggcgctcgcaaaaagcatccgtaaagatacactcggccttgaaccgcatgaaattgcagcgctgtacagggaacgcaatgcgatgctccttgcgatgaaagaagggattatcgccgtaaacaaagaaggcgcggtaaccatgatgaatttatctgcggctgatatgctgaatcttccggaaccgatgatcggaaggcatataaaagaaatcatgccgggcgcaaagctcatgccggtgttggcagggggagaattaccgccgaacgtggaggtgcgtgccggagataaagtatttatcttaaacgtgaaagaaatgaagcagaacggacaagtatacggagcggtgatcagcttccgcgaaaaaacggagctcaagaaactgattaacaagctgactgaaatgaaaaaatactcggaggatctccgggcgcaaacgcatgaattctcgaataagctttacgcgatactcggtctgttagagctgggagaatataatgaagccattgaactgataaaagaagagtacgccatccagaatgaacagcacgaaatcctctttcaaaacattcattcacagcgggttcaggccatactattaggaaaaatgggaaaggcgtctgagaagaaagtgaagctttcaatagatgaaaacagctttttagaatcgctgccggagcatgtgggttcatcccagctcattacgatcatcggaaatcttattgataacgctttcgaagccgtcgccgaaaaagagaaaaaagaggtatccttttttatgaccgatatcggcagggatatcgtcatcgaagtggcggattcaggagacggcgtgcctcaggaaaaaacagaaacgatatttgaaaagggctactcttcaaaggggacaaggagaggatacggcttagccaatctgaaagaagccgtcagtgagttgcagggagcgattgagatttcgcagcaaaagagcggcggtgccgtatttacggtgtttataccgaaagaaaggccaaagggggaatcggtgtgattaacatcgcgattgcagaggacgactttcgaatagcgcaaattcacgaaaaatttatcgaacatcttgatggattcaatgtcatcggcaaagcaatcaatgccaaagacaccatatcgctgcttgagaaacggcagcctgatctgctgctattggatatttatatgccggatgagctgggaacagatctgctcccgcttatccgcggccgttttccttccgttgatatcatcattattacggcttctgccgaaacaaggctgctgcaggaagcgctcagatcaggcgttgcccattatgtcataaaaccggtgtcggcacataaatttacagaagtgcttttgcagtaccgtgaaaaaagagaatggctgcactcacagccggagctgagccagtccgtgattgacatgtttttcggaagcggtcagaaagaacaaaaacagcacaatgatctgccgaccgggattaattcgattacgcttcaaaaaatcaaaaacgcgctcagaacggcccaaaaagggatgacggctgaagaactgggagaaaaaatgggtgcctccagaacaacggcgcggcgctacgccgagtttctcgtttctcgggaagaagcgctcgctgaattagagtacggcattatcggcaggccggaacggaaatattatttagcacatgagtaagggatgggagaaatgaagcggttgggagtgcttcttgtcatgctggcggcgctggtttcttttgacggacggcaggcggcgggcatccgttcagctgaagggccggttgaaatagtcgtcccggcagcgcctcaaggggctgggacgtaacggcaaaagctttgcaatcggtaatagagcggaagcaaatattaggccggcccgtaaagatcatctataaacccggaggaggcggagacagcggctggaaatatgtaaacgaacgaaaaacggatgtcatcagtatgaattcaagtctgctgttaagcaatgaaattttgggacaaagccggctgaaggcagctgattttacgcctttggccattatcgcaaaagagtggcagaccgtcgctcttccgaaggattcaaagataaaaagcggaaagcggctgctcggcgatattaaagcaaatccgggcggcataaaaatcggatttgcgcccggcctcggaaatgatgaccagctctcctttgcgagagcggcggaaatggccggaatttctccgtttgatatccgcttttttcaatacggaagcagcaatgaagtcattgaagctcttatcagtcacgagatagacgccgcctcaatgaccatttcagaagcgagagacgcctatcggaaagggaaaatcacattggcggccgttacgtctgacaaaaggctctccggcttcagcgatgtgccgacatggaaagagcagggggtgccgtttgtctttgcgcactggagaggcatcatggggccgaaagacatgaccgaaggcgagatcgcctattgggatcaggctttgaaacagattacttcatccgcggagtggaagcaaatgttgaaaaaacgggattgggagagcttttataaaaacagcagcggcgcaaaacgctttttagaagagcagaccgagttttataaagagatgatgagcagcgaaaaataagccttccgcatatttgcggaaggcttttgatttataaatgaacaaaatgaacgaaaaggttataaaaaattaaaaatctttaaaatccaaaatatttacttcaatatccaattctcataagatagcaaaaaggcggataaaggggatcgggcctttaaaatgtaagcgtattcatgatgagggggacatactgtgttagcaatcttaggctttcttatgatgcttgtttttatggtgctgattatgacaaaacggctttcagtgttaacggcgctcgtattaacgccgatcgtgtttgcgctgattgccgggttttcttttaaccgggtcggcgagatgatgatctccggtattgaacaggtggcgccgatcgcagtgatgattatgtttgcgattctttatttcggcattatgattgataccggtttatttgatccgatggtgtcgcgtattttaaagctggttaaaggcgacccgctcaaaattgtagtcggaacagccgttttgaccatgcttgtcgcactggacggagacggctcgacgacgtatatgattacgacaagcgcaatgctgcctttgtatatcatgctcggaatccgtccgattattttagcgggaatcgccggggtcggcatgggtatcatgaacacgattccatggggcggcgcggcgccgcgtgcggcgagtgcgctcggcgttgatccggcagagctgacggggccgatgctgcctgtcatcgcgagcggaatggtgtgtatgattgtggtcgcttatgtactcggaaggatggaaaggaaacggctcggggtgatcgaattaaagcagccgtcccatacaaatgaaacggctgcggctgcggaagatgaatggaagcggccgaaactgtggtggttcaatttactgttaacgctttctttagtgggatttttagtgtcaggaaaagtgaatttaaccgtgctgttcatcattgcgttttgtatcgcgctgattgtcaactatccgaaacttaatgatcaaagggagcgcatttcagcccattcgagcaatgtgcttgcgatcggttcgatgatttttgccgcaggcgtgtttaccggaattttaacggggacgaagatggttgatgaaatggccatttccctcgtatcgcttattccggaacagatgggaggttttattccggcgattgttgccttaacgagcggtatctttacgtttctgatgcctaatgacgcctatttttacggcgtgctgcccattttatctgagactgccgtggcgtacggtgtagataaggtggaaatcgcccgcgcttcgattatcggccagccgattcatatgttaagcccgctcgtgccgtcgacgcatttattagtcgggcttgccggggtcaccattgatgaacatcagaaatttgcgatgaaatgggcggttcttgccgttatcgtcatgacggcctttgcgctcatcatcggcgcaatcacgattttttaacataaaacacccggttcgtcgcacactaaaggcatcagaggaggtgccatgatgagtgatccgtttatgccgcttttttcagtgagaagcggcgccggttttaaagcggcggacggcgtttacggactgaccgtgcagattgcgaatgtttactttatcgaaaatccctcagctccgcgggaaatcattctggttgacgcgggaatgcctcaatcgtcggagatgattacaaatgaaatgaaacgccggttcaaagaggggtatgagctgaaggcggtcattttgacacacggtcattttgatcatgtcggtgcgattgaagaactgcttgagctttggaatgtgccggtttacattcatgaaaaggagcttccgtacgtcacggggaaagcggattatccgcctgccaggcccgatgcgaaaaaagggcttgtcgcaaagctgtcaccgctgtttccgcgccatacgatccgcattccgtccgttcaggcactgccttcagacggtaccgttccgtttcttgaagaatggaaatgggtgcatacgcccggtcacacacccggccatatttcattattccgggataaagaccgcgtgctgcttgccggtgatgccgtgatcactgttgaacaggaatcgcttgcggacgttgtcattcaaaagcaagagcttcacggtccgcccgcctattttacagcggatacgcagacggcggccgcatccgttcagaaattggcggaactggagccggaagcgcttttgacgggtcacggaattccgatgacgggaaaaaactaccgtgaggatttgcttacactggctgaaaaactgcattccgttttgtaaaacacctgcgaaaatcacaggtgttttttcttcgcagtttccagtatgatacaaaaaaaccattgtgttcacacctaaaaacgatacaatgggaaacagatgtaaattgaaggagagagttttttgaaacatacggaaatactttgggatgaggcgaaggattttattgatgtctgctatcacgaactcggaatggaatcgcaaatcaacgcgcgactgcacgcgataaaagatgagatagatcggacgggaagttacgtccatacggcggaagagcttgaacacggggcgaaaatggcgtggcgcaacagcaaccgctgtatcgggcgtctgttctggcaatcgctgaacgtcattgaccggcgcaatgtgaacacgaaagaagaggtgcgtgacgcattatttgaacatattgaaatcgccacgaacggcggaaaaattaaaccgacgattacgattttccctcctgagaagaacggggagaaacaagtggaaatctggaatcaccagctcatccgctatgcgggatatgagactgaaaaaggaagagtcggtgatccggcatcatatgagctgacggctgtctgcgaaaaactcggctggcgcgggaagcggaccgaatttgatattctgccgctgcttttccggatgaaaggggacgggcagccggtctggtatgacctgcctcagacgctcgtgaaagaagtgccgatcacccatccggatattgaagagtttgccgatttaaatctcaggtggtacggggttccgattatcgccgatatgaggcttgaaatcggcggactgtcgtacaacgcggcgccttttaacggatggtatatgggaactgaaatcggcgcaaggaaccttgctgacgaaaagcggtatgatatgctcaaaaaagccgcttcggtcatggggatttccgccagcctgaataccgacctgtggaaagatcaggtgctggtggaactgaataaggcagtgctctattcatacaaaaaacacggtgtcagcattgtcgatcaccatacggccgcgaatcaatttaaacgctttgaagaacaggaacaagacgcgggcagaaagctgacgggcgactggacctggctgattccgccgatctcgccggcttccacccacattttccataaatcatatgacaatacgattgtgaagccgaattatttttatcaggacaagccttatcagtaactgatggaaaaggtgcggtaccctttcagacggtgtgattcttcgatggttacgtttgtgacatttgagaaggggctgccttttctgaccgcttcggcaaattgttttaacgactcttcagggccttcggcaaggatttccacccggccgtcatcacggttttttacccagccggctatcttatgtctgtcggcttccatctggacgaagtagcgaaaacctacgccctgaacccggccgtctgcaatcatatgatactgaagcatggaaaaaccacctttttcttactatgataaaggaaaggtaggatatttcgcaaaggatgtgaacgagatgacgcaagactattctgtcttatctatcaatctcggaaagcccgcaattcatgaatttgccggcagacaaatcaattcaggcatcatcaagcggcccgcagattctcccgtcatgctgtataaaacccattttgacggggacgggcaggctgatctgaagcatcacggaggtcccgataaagcggtgtgcgtgtatcccgccgagcattattcatattgggaaacaacgctcgcgagaaaacttcccgccgccgcgttcggagagaatgtaacggtcaaaggactggccgaacaagacgtgtggatcggcgacatctttcagctgggtgaagccgtcgttcaagtaagccagccgcgccagccctgcgtcaaactcgcgctcaaatatggcatcaaagatatggtgctccgtgtacagcagacgggatttaccggcttttatttcagggtgcttgaagaaggatatgtcgatccgcgtcccgtcctcaagcgtctgtcgagaggcaaagaaagcatttccgtctggtatgcgaacgaagtgaaataccgtgattcagacaatctgtcagcgattgaagaaatactgcgggaagaagcgctgtcagaaagctggagggagtccttccttaaaaaaagggacaggctcactaatgtatagaaaaaaagccgtgctgcactgacagcacggctgatttacgttatgcttgtttctttgtttccagcagattggcaaggaagtactttttgaagctttgaagctttcttccttcatagtgggtaattccttttttctttaactcttctacataccagcctttactgccataatgcatgtcagaaaactcctttctccgttctcccgctggggaggtttcttcagtttttgccaaacttttggcattgtaacatctataaaaagacgctgaaaagggataatgcaaaaactgagcctttcgattcagagatgtaaagctttcttacatatatatgtaaagggcggtcttttcatgcttaatggccggttaattttaacagcaccgttccgagtgtcatgattccgaaaacgacgccgaaataaatcagcatccccttctttttcttcaccccgtaaacggtgagaatgatgctttcaataaagaaaataaacccgaagataataaaccacatgttgaaaaatggctcctttcacagacatatgtccagtgtagcacaactcttataacggagcataaaaaagccgggcactgtatcagtgtccggcaagtttgacgagaagctgggccaaatgctgtttttcattatcatccgcgatgtcccacagttcttgtaagagtttttcttccgcattgcggggctcctcgtgtttggcgagatagtccccgaggatggcggcgcttttgatgattttgctgtcatccagacccagtttttttccggcggaaattttctgatgaaggtacgccttaaattcctcgaaatcctctaaaatctgctgtttcgttacgccgtgcatggcgtgtatttcgttttcaattttgattttttctttatcttttttcatgcgtctccctccttcgggttagttgttgtatacctgttcgggagggagatgaaacattacaatgcagttaaaataatcggtttgtcttttgtaatcacgatggtgtgttccacttgggcgacaaggcttttatccggcgttttatatgtccagccgtctcccgcttcaacaatcgtttccgctttcgtggaaataaacggctcaagcgcgatcacggttccgtttttaaacagcgcgttatcaaacggatcgtagtaattcatgatgtggttcggcgcttcatggaggtttctgccgattccgtggcccgtcagcgttttaatgacggtaaatccgttggagcgggcttcatggtagacggctctgccgatctggttttgacgtttgccggcttttgcctgatccaatcctttctgaaatgcggatgccgcgcagttacaaagcttttgcagacgttcatcgccttctccgagcacaaatgaaatgcccgtatcggaataaaaaccgccgaactccgccgaaatatcgatattgacaagatctccggcttttaagattttagaggcgctcggaatgccgtgagcgacttcgtcatttacgctgatgcatgtcacgcccgggaaatcgtattccttctccggagcggaagcggctccgtgctcgtcaagcaccgcctttccgatcaggtcaagatctttcgtgctcatgccgggctcggcttttttcttcatttcttcacgcgccagcgcgacgattctgccgatttttttaaggccttctaattcttgatcgttcgttacaatcattgtcattcccgctttctatttttaatcatctgattcaagcttaccacaactggtttataaatagaaaaccaacaagccttatgtgaataaatgaaggaaaattggtatagatcactagataacttatgtggtatatttaagaaaaaagaagggggatgggtaaaatgcttcaatttttgcaaaaactcggaaagtcttttatgcttccgattgccgttctgcccgccgttggtattattttggccatcggcagagaggacttattaaatattccgttcatttacgcggcggggaccgcggtatttgatcatctgccgctgattttcgcgatcggaatcgcgatcgggatttcgaaagacagcaacggggccgccgctctgtcgggagccatttcttatatcatgctggacgcggctgtaaaatcaatcaattcgacaaataatatggccgttttcggagggattatcgcggggttaattgcgggatacacgtataatcgctttaaggatacgaagctgcccgaatatctcgggtttttcagcgggcgcaggctcgttccgattgtaacggcgctgattaccattattttggcgggtatcttcggatttgtgtggccgccgattcagtcggtgattacgtccttcggggaatggatgatcgggcttggcgggatcggcgcggggatttacgggatttttaatcggcttttgattccattcggtcttcatcatgtgttgaataatattttttggttccagtttggcgattttcacggaaaaacgggagatctggcccgcttctttgcgaaggatccgacggcggggacttatatgacgggattcttcccgattatgatgttcgggcttccggccgcttgtctggcaatgattgccgcggctaagccaagtaagcgcaaagcgacggccggaatgatgatcggtctcgcgctgacggcatttattaccggaattacagagccgattgaatttgcatttatgtttttatcaccgcttttgtacggggttcatgctatattaaccgggttctctttatttatcgtgaatgttctcggaatcaggtcaggtttttcattctcggcgggggcgatcgattatctcctcagctacggcattgccgaaaaaccgcttttgctgctcgttgtcgggctttgttatgcggtgatctattttgccgtcttttatatgctcatcaaaacgttaaacttgaaaacgccgggacgggaagatgatgaggaagaggaagaagtgcttagtgaagatacggccggttccgtcgaagaacatgccatgctcaaggggctcggcggcaggcaaaatctcgaaacgattgatcactgtgcgacccgcctcaggctgaccgtgcaggatacgtctctcattaatgaggcggcgcttaaaaaagcgggagcaaaaggggttatcaaaacggggaataaaacggcgcaggtcattatcgggccgaacgtcgaatttgtcgcggaagagctgagagaggccgtccgccttgacgatcagaagcagacttgaaaaatccggatcacctatgtgatccggattttttttgaacatatatcaagtttcacataatgtacaaaaaacaatgtttccttctatgttaagattcatgtagaacaagtatggagatgatgtaaggtgacatggattgcagttgtttcaattgttgtcataagcctgattaagattgtgctgacatgccttcctaccggagcggtggaatggatcctccgcaagtttgaaacccattcaaagctcagtgacgagtccgctgccgtttccctcgggggaaaacgtctggaaggcgaagacaaacgacgggtgattgatgattttaacgaagccgtgtttatcgaacggcattatatatacccagggatgaagagcgttatcttcatccgcaaaacggagccgatccgcttgtcattaagacgagaaaaggaaaaaaagatgtgacggtgtttgtatacagctacgaagatcatgtagatgtcgtcaagcagcagaaaaagaaagtaatcgcttattcagttctttccgacagcctgcaaaagcgcactatggccgccgccgggagctgaacataaaaaagccagatcatatcaatgatctggcttttgtttattctttttgatcgtctgctgaggaatcttcacgcttcgtataatcgaattgtgacggatccactttcttgaagcctttcggctgatagaaacgaagcagatcgccgttgatgatcttatcagacatttcaagctcagtcttgacgagagagtcttcttttttgtcgacttctgaatcatctaaaagtcttccggttttcgtatcgtaatacttgccggacactttcgtatagttcggcgagatgaagtctccgttacggaacggaatgacttctctgtgctctttcgataagatatcagaacctgacatgagataatctttcgtatcgacgccgagcagatgaagaacggtcggcgcgacatcgacttcaccggcaaatttatgattgcggccgcctttcacgccgggagcgtggataaagagcggcacccgctgaagctgggcattgtcgtattcagtgatctcatctttgccgagcactttcgccatcgctttattatggttttcggagatgccgtagtggtctccgtacatcacgataatcgacttatcgtacaggccgtcttttttcaggtcattaaagaactgttcaattgattcatccagatagttcgcggactggaagtaattattgacgactgaatcgccaaagtctcccgccgggaagtccgtgtcttctttatccattccgaacgggaagtggttggacagcgtaatgaacttcgtatagaacggctgcggcaggctctttaagagcggcatggattctttgaaatacggtttgtctttcatgccgtagtttttcgtattttcttcgctcatgtcataataagcggaatcgaaaaacttatcgatgccttccgatttgtacatttcgttacggttccagaaagtctgcgtatttccgtggaaagcggcagacgtgtactttttgccttttaagatcgcaggaacggactgcagcgtgttttgcgctttattgacgaaaaccgaaccttgcgaaagcgggtacagagagttctccatcataaattccgcatcagatgttttaccttgtcccgtttggtggaaaaagttatcaaagtagaatgtttgattatcgtgcgccagtttgtttaaaaacggcgtcacttccttgccgttaattttgtaatcaatgataaaggactgcagagactctaatgagacgtagatgacgttttttccttcggcttttccgaagtagacgttattcggcacgtcatagttggccttcatatagttttccacatccgttacatcgcttgaatcggcaagcgcgcgctggctgtttgatttcacattctgcacggcatcgtaaatcgtaaagttgtacgtgcccaagtatttcaccagatagtttcggtcaaatgagcgtgtcaaaagctcgggacggtcggattccgcgacggcgaggttgatcaggaacacaagcacggcggaagccaaaacgattctgaatgatttcttcgccggtttttcagccggttttttcatcttaagggccaaaataatcaaaatgacggtatccaggaagtagaaggcgtctgtccatctcattaacgagaacgcgctgtctccgagctggccgccgtttgtctttgcctgcatcatgaccgggatggtaatgaaatcattaaagaatctataatagacgatgtttgcaaaaagcaaaaaagacaataaaaaatgaatcacaataatggctgtctgctgtaatttcttcttgaaaagaagcccaaatccaagaaagaacaagctggagctcagcggattcacaaaaagcaatattttctggatcgtgttgtctatgccgaggttaaagtttaaaatataagcgacatatgttttcacccacaataacacgaccgctatcaagaagaaggcaagtcctctttcttttataaatgttttcattgttacactccttttttccgatcacggtttacacggaacgatagaaaaaacgaacgtaatcaatataccatgaaaccagcaaatagaaaaggtggaaaaggctcatcggaaaaagggcgaaaaacgctgtcgcagcggcggttgatctgttgaatgacagctttaaaaaacacaaatggcacaaactgggatgtgaatttccgtatgatcacacccgattctattgaagaaagaggtaaacagtgatggatattgcgcatatcgtggctgaagataaaatcaagcgcgccattaaggatggagagttcgccggcatcaatggaatgggaaagcccctgccgaaagacgatgccgcacatcttccggagtcgctcagaatgggctaccgcatattaaaaaacgccgggatcgccgaggatgagggcgcgctgaagaaagagctgatgacgctcgattatttgatcgccaagtgccgcaatgaacaggagcgggatcacctgcggaacaaacggacggaaaaacaagtcagactcgacaaactgacggaggagaaagccatgttctcaaaacccgcatcttctcattataaggagaaagtgtacagacggctgggccgcccgtaagccggctctttatatttttttctgaaaaggaatgtgctccataaggcgcgggtaggaaatgtggagcaggccgtttacgcactgcgcctgtaacaggtggggctcagccggttcaggaagctcaatcgtctcatcgatttccccgtaataccggttttggcagacgcccatgttcttcggaaaaaggggtgtgatgtttcctcttatatgcagccgtgttcttgacagcagcctcaatgtcaattcttcttcgtaaacgccgggcatttccacaatgacaaatgtgtgctgttcatcctgataaatatcataagtcagggtgtttttttgtaaggagaaaaaatcttcgggagatttccgtttcaggacattggtccaaaagtcgctgggcttgtgctcgttcgtaatctcaagccactttctcattttttcgatatccacttcggcagaacctccctatatttgatttgcgatcggcattgacgggttggcgatctgatcctgatcgctcacgtcagggtcaagatggcccgaattcaaacatccggcggccggcgaaaaatcccctaaagaaaagttcgcgccgacaaatttgctgttggcggtgtggctgttttgtacggtctgaccgatatcgacgtttccgttttgcgttgctccgtttacttttatattgacgacgttaatttggtaaggcattcataaaaacccctttaatctataatgggcggcaccggcgtaatatttgcggtatctgcggttccgatggctgtctggtcgttgacatcaggatcatttaacaagttctccatcatcgattctataggtgacgtatcgccgaatgaagagttcagtccttgtgatttgttatttgtggtgggactgttgtatgccgcttccccaatcgtaatagatccgttgccagaaatactgttaatcttcaaatagtacaggttgataacagtggatggcatctcttcacacctctttaacttagttgtacagtactgtatgctttttgtgctcctgttgtgaattccgcccggacatgttcccgaccaaacaagaagtcaaggcccggttccggcggggctttttttgtttcagggtctttcgcagtatatttgtgatgaaagcgctataaaaatagattgacgacatgtatatacatcattacaatagagtcataaacatgtatatacaagttttttgagacaaaatgaaaacggttacggaggggttggcatgggtgagtttaaccgggctgcgcggcagatcgctgaagctgtcggcggaatcgaaaatattgaggcggcgactcattgtgtgacgcgtttgcggtttgcattaatagatgaaaccaaggtaaaccaaaaaatgcttgatgcaatagacattgtcaaaggatcttttgcggtaaacgggcagtttcaagtcgtgatcgggcaggggacggtcaacaaagtatatgcggaattagtgaaggaaacggggatcggggaagcgtccaaggatgacgtgaagaaggcggcatcgcaaaaaatgaatcctttacagcgtgctatgaaaacgcttgcggacatctttattccgatcttgccggcgatcgtcacggccgggcttttaatgggtctgaacaatatcttaacggcggaaggcattttttacagcacgaaatcgattgttcaagtgtatccgcaatgggcggatcttgccaatatgattaatctgatcgcggggacggccttcgcttttctgccggctttaatcggctggtcggcagtgaagcggttcggaggaagcccgcttttgggcatcgtgctcgggctgatgctggtgcatcctgatctgttaaacgcatggggatacggggccgccgagcagagcggcgatattccggtgtggaacttgttcggccttgaggtgcagaaagtcgggtatcaaggtcaggtgctcccgattctgctggcgtcttatttacttgccaggcttgagctctttttgacgaaacggacgccggagggcattcagctgttggtcgtcgcgccggtgacgcttttggtcatcggttttctatcctttgttatcatcggtccgatcacctttgcgatcggtaacgcgctgacggcgggattgattgccgttttcggccaattctccgccatcggaggcctgctgtacggagggctgtattcggcgcttgtcatcacggggatgcatcatacgtttctcgcggtcgatcttcaattaatcggatcaaagctcggcggcacatttttatggccgatgctcgcattatcaaatatcgctcaaggatcggcggctctggccatgatgctcattacaaaagataaaaaacagcgggggctttcactgacggccggcatttccgcatatttgggcattaccgagccggcgattttcggcgtgaatctgcgttacaaatttccgtttgtgatcgccatgatcagctcggggattgcggggatgttcatctccgtcaaaggcgttctcgcaagctcggtcggagtcggcggcgtcccggggatcttctccattatgagccggtactggggtccgtttgcgatcggaatgctgatcgtgctgatactcccgtttgcgggaacatacgggtatgcgcggctgaaacggcaaaaatagaaaacctgcggggcgccttctaacaggctgtcccttttccctttccattcaaaacaatacaggcggtgaagaaaaatgaaaacagacagcacaccatggtggaaaaaggcagcggtatatcaaatttatccgaagagctttaatgatacgacgggaaacgggatcggtgatctgaacggtattatcgagaagcttgattatttgcagaagcttttgattgatgtcatttggcttacgccgatttacgattcgccgcagaatgacaacggttatgacattcgcgattactgcaccatttatgaagaatacggaacgatggaggattttgaacgccttctcgatgaagcgcacaaaagaggaataaaggtcgtcatggatcttgtcgtaaaccatacatcagtcgagcatcagtggttcaaagaagcggtttcgtcacccgacagtccgtatcgggatttttacatttggaaagacggcaaggaagacggccgggcgccgaacaactgggaatcaaaattcggcggttccgcttgggagctcgatccggcctcaggccagcactatctgcatttattcgatgtgtcgcaggccgatttgaactgggaaaatgaagagatgagaaaacaggtttacgacatgatgcatttttggttccgaaaagggatcgacggcttccggctggatgtgatcaacctcatttctaaagaccaatcgtttcctgatgccgaggatggtcgtgacgggcgcccttattatacggacgggccgcgcgtgcacgaatttcttcatgagatgaaccgggaagtgttttcgaaatatgacagcatgacggtcggtgaaatgtcctcgacaacggctgaccactgcatccggtacacaaaccctgaaaataaagaactcgatatgacctttaactttcatcatttaaaagtggattatccgaatggtgaaaaatgggcgctcgctccgtttgattttctgaagctgaaacggattttagcgttttggcagacggagatgcaaaacggcggaggctggaacgcattattctggtgcaaccatgaccagccgcgggccgtatccagatacggagacgatggcgtataccggacgaaatcagccaaaatgctggcggcggccattcatatgatgcagggcacgccttacatttatcaaggtgaggagatcggcatgggcaatccgaagttcgatgacatcggctcataccgcgatgtcgaatcactgaacatttacaaaaagatgaaggaagaaggcgtgtcagaaaaagacattatcgccattttaaaagagaaatcaagagacaatgcaagaacccccgttcaatggaacagcgggccgaacggcggcttcacgacgggaacgccttggattccggcggcggatgattatcgggacattaacgcggaagcggctttgcgggacccggattcaattttctaccattatcagaagctcatcaagctcagaaaggaatatgacatcgtgactgaaggaacgtttgagctgcttgctgaagatgatccggcggttctggcgtacgtcagacacggcaaggatgaaaaacttctgtgcatcaacaacttctacgggaaagaagcggactttacggttccgcttaaagacacggacggctggcggtttacggtgctgctgacgaatgatgaaccgagggaagggcggccggaacgattgacgctccgtccgtatgaatcgatcgtttatcatctgacaaaagcgtgatacactaatctgggtggtcatgaatgaaagtgaataaatatatcacaatctataaagatatggtgcggcagattgaaagcggccagcggaaggctgaagacgttcttccgtctgaaaatgatttatgcgatcaatacggcacatcacgagaaaccgtccgtaaagcgctcaatatgctggcgcaaaacggctacatccagaaaatcaaaggcaaaggctccgtcatattagacagagaaaaaatgcgctttcccgtctcaggcctgatcagcttcaaagagctttcggaaacgctcggaaaagagacgcgaacggaggttcaccgtctcgggctgatcctgcctccctcagaagccgcaaaagagcttggtacagtggcggatgaaaaggtgtgggaagtcgtcagatcaagacggattgacggagaacatattattttggacaaggattactttgtgaaaaaacatgtgcctctattaacgaaggcgatttgtgaagattcgatctatgagtatctcgaaggagagctcggcctgtccatcagctacgcgcaaaaggaaattgtcgtggagccggcgggggaggaagaccggaagtatttggatctcggcgggttcagccatatggcggtcgtgaaaaaccgcgtctttttggaggataccagcctctttcagtacacggaaagccggcacaggctcgataaattccgtttcgtcgactttgcgagaagagaaaaataaaaacggactgccgcggcagcccgtttttttgtcagtatcaaaatgaatactatccaacaaaaatgtgcgtactggtactttcaaaaataatggctacaatagtacataacgagataaaaaggagagatcatgaatgtcagataaaaaacagcagatcatcgaagcgtatcaattcagacacgctacaaaggaatttgatcctgagaaaaaaatttcagaaagcgattttgaattcattttagaaacgggaagattatccccaagctcactcggtttggagccttggaaatttgtcgtcgttcaaaatccggagcttcgtgaaaaactccgcgagttcacatggggggcgcaaaagcagctgccgaccgcaagccatttcgtacttctgcttgcccggacggcaaaggatatccgttttgacgccgactatgtcaaaaaccacttgcgggaagtcaaaaaaatgccggaagatatgtatgaaggctatatcagcaaaacggaagacttccagaaaaatgatttcaatctgcttgaatcagatcgcgcgctgtttgactgggcatccaaacagacttacatcgccctcggcaatatgatgacagccgctgcgcagatcggcatcgattcctgccctgttgaaggcttcaactacaaagagatccaccggattcttgaagaagaagggcttctggaaaacggaagtttcgacatctctgtcatggccgcattcggctaccgtgtcagagaaccgcgcccgaaaacaagatctgcctcaaaagacgttgtaaagtgggtataagataaaaaaagctgccgggcgtgtcccggcagcttttaatgtttatttggttttgctaaaaaacaggcggtgatccaggacgtaacgggaatgatgatgccgatcccgattccggcgcaaagaatggtgacggcttccgcactgaatacttttgagttcactattttttcagctgagtatgataagtctttaaaccagataattaaagccaaatagctgccgaaaaaagcaaagaataacgtattcgtattcgttcctaaaatatctctcccgatgcttaatccgaatgtgtacagttcttttctgctcatggacggattatgactgtaaatttcccgcatgggtgaagtaatggaaatcgcgacatcagtaatcgccccaatcgtgcccatgatgatcatagctgcggtaaccttcacaaaatccaccccgacaaacagtgtgaatatgccgatatcccccaattcttcttcaccgaatccctgaatcgaagtatgttttgttacggacataataaaaaacagcagcaatgcaatggtcagcatcgcagaaataaaggcggttacggttttgacgtttcctccattaatataaaaaagagtaatgctgcaaatcacggcggaagagagcaatgttaaaacaatcggattgatatgcggatctgtcatgaaaataatggtgagaaagagaaccccgaaatttaagaataacgcaataaaagacctcgctcctttttttccgccgataatgaccattaatagaaataaaatcgccgcgagaattacgatgacattcatgagcttgccttcttttgtttaataaaaaagacagaagcatacagactggcgggtatggttaatacaattccgatccccccggccaatgctctggctatttccaaggaaatgttcatagaaagagtgaatcctatcggggaatcatttttcaaatacaaaagcatcatcggaatagagccgcttatataagcaaaaaacagaatattggtcatcgctcccatgatgtcttttccgatctccatcccggaacgtctgagagcttgtaatgagatacccttgttttcttcatataatccgaagacagatgacgtcatggtaatggctacatccatgaccgctcccagtgatccgataaataccccggccataaacaccgtgtgataagggcgggttaaatactgcatttcctcatatctgagacctttctctccggttgccagcatcaccagatacgtaatcagcagggaaacgaaagtgcctgcgagcgtcgcggctatggcggcatatgttttcgcgtgaaaaccgctgacaagcagcaatgagatgaccgtaaagatgagaatacagataccgcagataaaaattaaccctatattaggatgcttcctgtacaaatctaatgcaaacgacagtaaaacggcgttaaacatcaggctgacgatcgaaaagaagccttgtttttttccgacgataagcaaggtgaagatgaaaacccaagcgatcagcaaaagctgtttatcccgttttttatctataatgcttcccgatatatctttgtttgatggtttccctttatcaatagaaacgaatacttcatcgccaatcgaatatttctgatcattcgctccggataaagaatactgattggacaaatgaatgagctgccctttctgactgccgttttcaagtctggcagtgatcgtctgattgaaaatcttatctttgtttttatgcatgtcctgtacgtttgcctggtgttccaaagttgttttcgtcactctggcaatcggccgctcataaaaagaagcgttgtgagtgacaaaaatgatcgagctgataaaacaaagcgctgttatcacgtaaaacagctttttcttgtaagacatgcggtttcgtttgtttcctgtaatcttcaaaaaaagtcctccaaacaggcggcgccgtgtaaaagagaggctccgccgtgaagtgttaaacgatgcggatgcagtctttcgcgaataacgttcatattttatcactcggccgtacggctgtcgactcagagggggaccggcagaaaaagctctcctgatatcagatcaggagagctcttgggatgaaccgcccgataaaagcggtctttttatgcttcgttcactttttttgcttttcttctttggtacagatacagtgccgttccgagcgcgctgatgagtaacccggcaagaaggatggaatacatcgttgtggctgtatcaggaagcaggccgcccggcgatactccgtcctgcgcagggccggatgacggtttttgtccgcttggctgctttccggagccgtgatctccgcttgtcggcggcgcgctcttcgtgtttgcgtttaatatggtgtattcactgaaatgatttgtatagcccgtgacgagatcgtgtgaaaccgaaccgttgtctgtttttgtatagacgttctttttccggtctacatgataaatgccgggctgtttcgcctttttcatattctcaatgcgcagggtgagctttaccggcgctttgaatgttttgatgtctttgtttttctgcttcattgtaaagtcgtatacatttgaaagcgccccgctaacttttcctttcggcgccacgccgaatcgtgtatcagctgaagcggcgtttgccatcggcattttcatgctgaacttgtcatgcaggatcgtaagggaagaatccgatgttctgtcctttaacaggccgatttgttttttggtcacgctgagatcaatcggctttttggcgccgtcattcttatcgtaatacacgatcggcgtgttggcgtttttggcatagacggcaaatgcgctgtcatcttcaagcgtccacgaaccgtttttttgttttgtcggcaggtacacttcctgcgcgcggccgtcaactttcggttccaccgcttttcccgctttttcaagctgctcaacgaagacctcatagtcggcaaagccaaggtcttctttatgggatgcttcgttaaagacggaatatccgtctccgccttcaccgacaaagttactggtggcgactctgtatgtcttcttatcagaaatcggctttacactgccgtcatcctgtacggccgaagcttgaagaacacggtgtcccggctttttattcagtgtaaacgtgtatgttaaaccggcaacttgagggaaggcgccgccttgagcctcaattccgcttaatccttgttccagggcttgtttgatctgttttccggttaaatccgcgacgtaaagcgtgttgccgaacggcattacattcagcacgtcgccgagtgtgatgtctcctttatcaatgcccgcgcggatgccgcccccgtttgtgatcgcgatttgggcgccggccgcttccttcgctttttgcagcatgccgtccgcgatgaagtttccgagattggtttctttggagcggacatgctcgcgccggccgtcaagtgcgaccttcgttgaaccgactttttcatttttaactgagacgagctcttttttaaacggatcaagctcttttttcagatccgggtcttctttcgtctgctcattcaccggcagcgcttgaagagaggattgttccggcaggacgacgccgtttttgtcaaatgcgacatcgacacggcctaaatattcgccgtattcttttgcctgggcgacgatggtcggctcttcgtttttgacaatttccattttatctacaagcgtatgcgtatgtccgccgacgattaagtcgatgccttttacttttttggcgagatcgagatcacgctgatgtccgatatgggtcagggcgataattttattgacatgttccttgttctgtatttcttttaccgtatcttgtgcggattggaaggcatcatgaaagacaatgctttttcccgggcttgatgtgacggacgtatcttctgtcgtcaagccgaatacggcgactttttctccgtttacatcaagcagaatatatggatagatgcctgcttttttctttttccctgccgtaaatgtgtctgcttttttcatgaatggtctgagttttgactctttggacacatcgacatttgagctgacgagcggaaagtcaggtgcttgaaaattgtatttcccggacgggtcagacgcgctcccgttaccgctcaagaagctggcgagagcacccggacctttatcaaactcatgatttccgaaggtcattgcgtcgtagcccatgctgttcatcaattttaaatcagccagcccctgccactttgtgaaatagagatcgcctgagaaaacgtctcccgcatccagcaaaatgctgcggtcggtttcgcttctgatttctttgattttcgtcatccgcctcgccgcgttatcaaggtgggcgtgcgtgtcatttgtatgcataacggtgagtttccatgcgtcatctttcggcggatctgtgcccggttcatcatctttgaattggagcttgtactgtccgtagcccgcgttttgtgattcaccgatataggcgacgtcatctgcgcggtcggcaaacggctttgcggccaaggaagattcaaatgtcagatttgtccctttgaccggaaggatggaccagttatgatcagcctgcggattaatcgttttctgctggatgatgtaatccattaagacctgcctgttctcatcggcagaagagtatacgattttgtcattgcttaagtgagggaatcctccgccgcctgaagcgcggtaattatttgtgacgatcagaaattcctgcttggcgctgacgggctttccttgataagaaaggttgacgatccggcttgcatcgggatgaatgactgttccgttttcgttgtatttcgccggttttgtgacatcgacctgataggtgacaccgtcaatgacatcaaaattgtatgagcggtaggcgtcatttaaaagcgcttggctgccgccttttgcctgatcgatctgattaaattgccccgcggacatttcgagccagtctttcacttcgcttccgttcagcttgacgatctgaaccgtgttgtcatacaggtacaaatcgccgatgtttttgatggcgaggtcgccagcggaaatgtttgtatagtagtttgagccgttccgcccgccggctttaaacggggcgcccgccgagaggataggcagatctttgtactccgtatccttcatcttattttcggcgtaccatttttgcgcatccgttacgatttgaatggacggatcatctttgacttgggcgaagaaactgttgatatcggcttttgtctggccgacgggttctctgatgtatttcaaagtgccttcgtgcgcttttttgacggtattgacgacggtttcgttttccgaattcacattgccggcaatcggctcgatgctgccttttgcatcttccacatgccacgcgctgtctgttttttcaagccggaggtcgatgacgcccgcatatttgccccagctgcttgacataacaacggggatgccgttaatcgtgcctttatcgacgtcgaattgagcagcgcctttgtattcggcatcagggaaaagcccgtgctgatggcccgatacgatcgcgtcaattccgccgactttcgttgccaggtcaaaaacggcgttttccgctccggaagactgcgcttttttttcgatgccgctgtgggcgagggcgatgacgatatcggctccttcagctttcattttcggaacggttttctttgcggattccacaatgtcctcgacctgaacgcggccttcgagatttttcttatcccacgtcatgatctggggaggaacaaagccgatatagccgacttttagctgatgcttgccgccgttttcatccgtgacggttttgtcttttatgacataaggcgtataacggttttcgccgcttactgttttcacattggcgttaacgatcggataatcagcgcctttgattgtcccgtccaggaattcaagcccgtaattaaattcatgattgccgagtgttcctgcgtcataatgcagactgttcatcacttcaatgatcggatgggtttttgcgcctgaaatgatatcatttttctcatattttacggcgtattctccgaggggattcccctgaatcaggtctccgttatcgacaagcaccgtattcgggttttcgcgcctgtgcttctcaataagctgagccgttcgggccagcccgaattccgttgtcggtttgtcgctgtagtaatcgtagtccatcatgttagcgtgaacgtcagttgtggctaaaatgctgagattcacactggaggatttgttttcttctgctttaatgggtgatgttgggaggatcagactaagtatcataactaggggcagcagaatacggagtgtcatattgacgctgcatcgtcttttctgtattctcacctgttctccacctttcaacaaattttgtcatgcagtaccattgtaagaatattttgtgaaagtttatatagatttcatgatgattcttgtgaaaagataaaaaatgaggataatgacctatgtaaaacaggcgggcggtaaacgcgttacctatgtttgatgttagtgtggctggggtacatggatttatgtagacttcatcaagcaggaggtagtaactatgggtaaaaaaattgcagttgtattaacggattactttgaggatgtcgagtatactgaacctgcgaaagcttttaaagatgcgggtcatgaattaaccgtaattgaacaggaaaaaggaaaaacagtcaaaggaaaacaaggggaagcggaagtgaaagtggacgcgtccatcgatgatgtgaatccgaaagactttgacgcattgctgatcccgggcggattctcacctgacatgctgcgtgcggatgaccgtttcgtccaatttgccaaagcgtttatggatgataaaaaaccggtgttcgctatctgccacggccctcagcttctcatcaacgcgaaagcattggacgggcgcaaagcgacaggatttacttcaatccgaatcgatatggaaaacgcgggcgcgaatgtggtggatgaagaagtcgtcgtctgccagaaccagctggtcacaagccgcacaccggatgacattccggcattcaaccgcgaatcattaaaactgcttgcgtaatataaaagcggagcgccgtatcaggcgttccgctttttttgtgaagattcccggatgaccagctcaggcgccagaataatgcgttgttttttgtgctgggaattggtgattttatgatgcagcaattgagccgcttcttttcccgactgccgcggaaaggaagaaacggttgtaagcggaggataagaaatttcagcttccggcacgttatcaaagccgacaatgtcaatatcttcgcccggaacgagcccggcttttctgatcccttgcatgacgccgaatgcgaccaaatcactgaagcagaaaatcgcggtcgggcgctcagaccggcggaggagctccgtcacggcgtcacagcctgcttcgcgggtcggcgcgctgtcaatgacatattcatttttcacttccagatccgcttcacggagtgcttttttaaaccctttcatacgcttcgtccatgttgatgagtgcttcacgccgcccagaaacgcaatctcctgatggcctttctcaatgaaatgacgcactgccttataggtgccttcctcataatcggctccgacaaaatcacagttggcatcggcaatctccctgacggcgagcacgaccggaatgtcaagctgctcaaggcgggaaagggtttcctcagccgtccctgaaaccggacacaaaatcaatccgccgaccctgtgctccagcatggtcgagatcagctgctcctgcttggcgacggaatcaaatgtcgtgcctaacagcaccgttaatccgacttcctcaagcgtattctgaacgccgatcagaaactctgagaaaaacgtattggaaatgtcagtgataatcaatcctaccgttgtggacgtctgtgatcgtaaattcgcggcgacccgatcatatacgtaccccagctcccgcatggattgcagcactttctcacgggtcgcttcggaaattcggggattattgcggacaattaatgaagcggtggatgttgagacgccggcatgttcggcgacctgctgcaatgtcacccggcgttttttttgctgtttcatacgtcgcattcctcacttggtttttattcgttacatccattataagcgttttggcgcatgagaagaaagagagaggagggggaaaaagataaagcgccggaagacggattgtccttcggcgcttctgtcacaataggttattcaaacatttgctctttaatatactgaaccggcatttcacggcctgtccaatattcaaacgccatggcgccctgccaaagcatcatgccgagaccgttaatggtcttgcagccggctgcttgagcttgttcaagcaatttcgacgtaacggggttgtaaacgacgtctgtcacaatcaaatccggacggagcatggatgtatcttcaataacactcaagccttcaagcggtttcatgccgacacctgttccgtttgtgaaaatatcgcttgaagcgatttcagcacgcagcgcatcttgatcttcgagcgggaagactttcgctttacaagaagatcccttcatttcttcattgatgatgcggacattttcttccgctttttcgaaaaacgcgtcattgcgggcgaaaatagagatttctccgaggccttccaatgcggattgaatcgctatcggagtggcggccccgccggaaccgaccagcgtcatttttttccctgtgatatcgatgccgtgttcttttaagttgcggacgtatcccataccgtcagtggagtgtccgatcagtctgccgttttcattaacgactgtatttaccgcgccggtaaatttcgctgaatccgcgagttcatcgagataagggagaatgttcatcttgttcggcatcgagacattgaagcctctgacgtttaaggcgcgcattcccgttaccacatcttccagctgttcattgccgacttcaaacgcgaggtaagcgtagttcaatcctaattttttaaacgccaggttgtgcatcgccggagataaagagtgtccgatcggtgtcgcgaataatccgataagctgagtttttccgttaatccgtcctaattctttcttcatgatgtattcctccgttagtccattcatttgtttttcctcccgctttgagggcaaaaaacgctgattacatatgtttatttaaaatgctgagtacgctgcgcaattcctcaacgggaatctgcccgggcgctgatgcttctttgcccgctccgaacgtgcacgctgagccgaagacttcgccggccagccggctgatcaggcctgttcccgccattgacatcgtgatgatcggccggtctgcgtattgtgttttcatcgtgtgagtggcatccaataagacgaaaacatcttcagtgctttgcggcatcaccgcgattttcggaatgtgcgcgccgtacgcctgcatgttccggagccgggaaatgatttcttcttttttcggtgtctgatgaaaatcatgattggacatgacgacatatacgccgttgtcttcagcggttttcacaattgatttgacttccgcttctcccgtaaacagctcaacgtctgcaaggtcaatatgttttgtttcgatggcggttttaagcaattcaatgtaaaagcggtcatcaataactttatttccgccttctttatgggttctgaatgtgaaaagcagcggtgttgctcctgcggctttccgcagcttttcaagcatgccttttacggcgtccaggctgtcaacatgctcgtatacatccgcccgccactcaatgatatccgggcgaagcctgttgacggcttcaatttcttcgagcagttctttctctccggccgccatcagcggcacaatgatcttcggaagcccttcaccgatgaccgtgtttctgattgtgatagattgcatgataaatcctctcccttaaaaaatagtcaggctttcatcacttgcttaaagcggattccgataaacaatgcgaggagggcgctgacggccgcaattccgatatcaagcagaaaaacaggcgtcaggccggcggctttggatatcgctcccgttacaagcggaatgacaataaaagataagcttgatgctatattaacaaaagatgtgattgtacctttatttttagggaataaaacagccataaccgtcatcgccaattgcagaatgcccgcagttgaaagtccgatgacaaaggagctgatgaccgatacggccggctgctgaatgaaaatcagagcaagcagcgcgattgccgcgatcacagggtacagcaccattaccgtaatcggctgaatcactctgtttaacagcacagccagcaataacacggacacaagcgccccgatgctgtaatagctcaacaatttgacggcctgcacctcaggcatgcccaaaacggattgcccgaacttaggaagccatacttgaacgagcataaacagcgccgttgatgaaaagcctaacagaatgatcgcaacgccttcgcgccatatcgacggctgtgatgtgaacgcgtcatcagacggagaggcttccgtccggccgccgtcttctttttgcttatgattcggaaacggaactttcaacagaaaaaagccgttcaggaagaaaataatgcccggtacgaaaaacgtccagccgtaaaacaaatgcctgtccgcaataaacgcgataaaaaacggaagcaccgtcgcgccgattgatacaaacgctttgattaacacggttgcagagcttgcgtttttcggaaatccttcaataagcgccggatatgtcccggaatccaaaaaggaattggcgatcccggcgaaaatggcgaagataaacgcggccgtatagtttgtcgaaagcggaatcccgattaggaaaatcagatacagaaaggcgcccgacacgataaacggccgtctcccgaatgtatccgaaagcttcccggcaaacagaagcgaaatcagcttcccgatcccgatggcggagaccaaatagctgacaccggctgcggaagtatgaagctgttttgataatgcctccatattggatgcgataataatattgatcatgcccagcaggaaatagttaatataaagacccgctgccattttggtgtatatgtttttcatgatgacatcccctaatgcggttaataaagaattaaattatttttttaattgataaaagcacagcaccatacccctttattgaaccactgcctttctttgaaaactgtttgatacaacggttgcatagacaaacttgaataacgctgatatcacaatgagtatatcgttctactaaacaaaaaaagataagcggcccgctcatttagtatatcgttctaccaagttcacagttactatactccttctttttatatgtgtcaaaccgatgaacttttattttttacttttttaaatcaaaaaagacccgccgtttttcggcaggtctgacatgggtttatttcctgagagaggcgagctcctcggcaatggcctgcatttcactcgggctgaatgatgcttttttcatgaccatttgatgaaggtatgtaagatcttctattttttcatcactgaaatcttccgctctgatgacgccgacattgagcatgttgagcttttgcgaaatgtcttcaatcattttatttaacgtttctgtttgttggctcggcaaattcatgcatcctttcatgatcgttttcgtcccctttattctaacagaattcatttagaataaaagcttatttccacagccgcagaaaaattgctaagatgttgataaggtttttgatcctcaaaatgcggggaaagaatagggaggttatcgatatgatacatgtgctgtttgtctgtctgggaaatatttgccggtcgcctatggcagaggcggtattttctgatatggtgaagaaaaacgggctgaacgggcagattaacattgattcagcgggaatcggcgcctggcatgcgggaaatccgccgcatgaagggacaaaggagatcctgaaggagaaagggatcagcgcaagcggcatcacggcgaggcaggtcgggtgagtctgatctgaccgattttgattacgtcattgcgatggatgcagaaaatatcggacatctgcgcagcatggccggttataaaaaagcggcgccgcgtattgcaaggctgcttgattatgtaccggagtcagaccttgccgacgtgcccgatccgtattataccggaaatttcagcgaggtgtacgctttggtcgagtccgggtgccgtcatttgctggagacaataaagaaagaccatcatttataaggggattgaccgatgaagcagacacgcatcatggcaaaagccattctgatcggcgctgccgccggcggagcactgtccttattacataagccgacgagagaggcatgtttccggaacatggacgcgtgcaggcggcgtgcggcattttaccgaaaacatcctgaagccctgaagcagcaggcttccgcaaaaatggatcaagtgaaaatcttcgccaataccgtatcggaagatctgagttttttaaacgggcagatcaccaagctgaagcagacgacaccgcaggtcattgacctgttaaaagaaacgaaggagcatttttcgaaaaacgatcattgaggtgggatgtcatgagttttataaaggagctgtttgcaaggttttctctgcatgaaggacaaagtaaatcggcggagctggcgtattttttcctgctgtcattgtttccgttaatgattttcatgctgacgctcaccgcctatcttcccatatcggcagaagacgtgctcggggcggtcgatcaatacgcgcccgacagcgccatgtccatggtgaaatccataacggagcaaacgctgaacaagcgcagcggcgggcttttgtcattcgggattatcgccgtcatctggtcggcttcgaatggtatgaacgcgattgtcagagcatttaaccatgcctacgaagtcgaggaaaaccgctcatttatcatcattcgcctgacctcaatttttttaaccattgcgatggtggttacgattttaatcgcactgcttctgccggtgttcggcagagaaatcggaatgctggccgcggatttcatcggcgcctcggacctgtttttgcaggtgtggtcggttgtccgctggggtatcagtccgcttatccttttaatcgtgtttaccgcgctttacatattcgcgccgaataaaaagctttccctccgttttgtcctgccgggagctgtattcgcggcagccggctggattatcgtcagtatgctgttctcattttacgtcggcacctttgccaactacagcgccacatacgggagcatcgggggaattatcgtcctgatgatctggttttaccttacgggaaccttgttgattttaggaggagaaatcaacgcgcttttacataaacgtaaaaagcttcctgatgaaaatccgtaccgcgggagcaagctatagaggaacggatgacgttcaagctgaaaaacggagggaatcggctatgaccaagcatacgaaaaaaggcggaagccataataaacaaaactcaaaaaacggcccgaagaataaaacaagcggaagcgccaacgggcagaacggataccactagaaagaagccgcctggctcagatcaggcggcttttttatgtggccggaaaagaatgggattcggaagcggggctgtgctttgttttcccgaagacgagcgcaagccaaatacagaccagaatcaccgtaataaagtaaaacaagttggcgctttcaaaccgctgcatataccagccgcccgccaccgggccgatcatgcttccgaggctgaaggaaatgccgcagagcaggttgcccgccggcagcagatgggacggcagcaggtcgctcatatagctgatgccgagggaaaacatactgccgaccgccatccccgccgtgaaaaagcagcagccgatgacagaaggcgacggaaacagtccggccgtcaaaaagcaaagggcacccgttaataagatgacgagcaggacacgttttctcccgaatcgatcgcttaataaaccgagagggaactggaatacaatacttccgatggcaaaagcgggcaatatcagcgcgacggcatccacggatatgcctaaacgaagggcgtacacgggaaagcttccgttcagcgccgtttctaaaaaaccgtacccgaaagccgggagaaaagcgacccagccgaaaagaagggcgcggtaaaaccgttttgcgctgttgtccccggatgtttcatccggaccttgcgccgggtactcgttacgtaaggcaaacacaaacagccaggcacaaagactgatacagccggatacgataaacggaagggacggacttgttttcacaagagggaccatgaacgggccgacagcgaatccaagcccgaaggacagtccgtacagcgaaatgtttcttcctctgtttcggggcgttgacttggaagtcacccacgtttgggttgaaaaatgcagcatatgatccccgattccgataagcagccgaagaaaaaaccataaccatatggattgaagccaaataaaactgaataagctgatgataacaagaaatccgcccatgaccatcagaggtttgaatccgagcttgcgcagcggggcctccataaacggcgacgccagaagcacgccgatataaaggccggttgcgtgaagtccgtttatggctgcggattctccgttcgtttcaaaaatgacggagatcaccggcagaagcatgccttgggaaaatccggagatggaaacaagcagaaccaaaataaagaagtacagtcgtgacatcgcgtatttctccttcttcagtatctttcttgatcgtacacggatttgccgcgtccggcaacctgaaaatgccaattcgggctgccgaggaagtgtaattgaaggagtttttgagaaggatataaaaagacttattcgaaaaaaggagccaggcagatatgaatcggatttttttctttacggctgcggcgggagtgccgctttcagtcatcggcggcctgatgcactggccgtcagcggttttgtttattatttattgcttgacgattattgcgcttgcaagttatatggggagagcgactgaatctcttgccattatcgcgggaccgcggatcggcggtctgctgaatgccacgttcggcaatgcggtagagctgattatatcgattttcgccttaaaagaagggctgacgggcatcgtgcttgcttcactgaccggttcggtgctcggcaatcttttgctcgtcgcgggattgtcattttttatcggcggtttgaaatacaagcggcaggaattcaatattcatgatgcccggcataattcaggcctgctgatttttgccattatcgtagcttttgtcattcccgaagtgttttccatagatatgggggaaaaaaacaagcttgatttgagtgtcggcatcagcatcatcatgatccttttgtacgtggcagctctttatttcaagctcgtcactcaccgcggtgtttatcagccgaatcagccggaggcaaaggaagaagaggagcagccagagtggtcggggaaaagagcgacagccgtcttatttatttcaactattattgtcgcctacatatctgaaaaccttgtccatacgtttcatgcggtggctgaacagttcggctggagcgagctgtttatcggggtgattatcgtcgcaattgtcggaaatgccgcagagcatgcgtcggcgattattatggcgtacaaagacaagatggatgtcgccgttgaaatcgcggtaggttcgactttgcagatcgccatgtttgtagccccggttcttgtgatctgttctatcttttttccggtcaatatgccgcttgtattcacattgcccgagcttgtggcgatgatatcatccgtccttttgatgacgatgatttcaaatgacggcgattcgaactggtttgaaggggctacgctccttgccgcttatgtcatcatggcgatcggttttttcctgctttaacctgtaaaaaatgcggataacaacgattgcggaggaaaagactaaaggaaaatgctatagaaagagtgatatgatgagaaagctgtttcatgccacactgattctgctgttatcctttagttttttcgcaatgccgtctgccggtgcaaagaaaccgtttaaggttcccaactctgttgtaagcatttcaaaggaaaatacgtatccgaatgcttcacaggaccagccgatgcttcagccgagcaaactggcaaaggaattgttagatacatccgagatcaacatcgaaaatccgcatctgataaaaatgctgaatgaatcctcggtttccggttcaccgcttgccatcggctaccgggcgacaatatttctcgggaaatgggcgctcggctatcaatcgaacgaaacggtcgccaactgggaatataaaaaaatcaatacgaacagagcggataaccggggcggacagcaaaccgcggttatctcatacgcccaagaacagcagtacaaaattaaaggcgggctcacagcgaaggtgccgaacgcagaagacgtaaaaagcatgatgatgcaaaaagcgatgaagaaaacaaaactgccgctcgcgtttgaaacggttatcggcgcaggcacaaaacgcgatcaaacctacaaaatttctccgcagcggctcggctacctgcacgcctacgctccggccgttaatgaaaaaggaaaagtaacatacggtgaagtgtatttggtgctgaaaggcagcaagcggaaacttgtcgtcaaaaatgtgacttcgcaaggaatcggggcttggattccggtgcaggatcacgtcacattcggttttcaaatgacagcgcagccgagataaataaaaaaagctgattccggttcgggaatcagcttttttgtgtgtgatacatttcctcaagcaattgcacattgttgttgtacagctcccgggcaagaacgcgtctcaccgcaaggcttgccgagaagtattctttatcttgaaccatgcctttgacggtaaattctatgcctctcgtcaatttgttcaggctcatgattccatgcacttgaaacggctccgtcgcattgagaaattcatcccgcttcagtgaatcgcgaagctcatcattgagcatgtcgcaggctttttctaagacggcatatacccgctcgggatcttctttataactgatcacgacggactcggtaatccgcataaaatcaatattatagttttgaagctgtctgacctcaccgtttgaaatggtaagcagcttgccggtccactcacggatctggagggaacggagcccgatttcttcgactgtgccgttgaacagattgttaatcgtcacgtaatcgcctttatgaagctggcgttcgtatatcaaaaagacaccggccaatatgtccttgattaacgactgggcgccgaaaccgatgacgataccggcaacacccgccccggctaaaattcggccgaaatcatgaacgaataacgaaatgacgtaaaagataaaaccgatcgtcgccgtatactgggtgatggatcggacgaggctttcaatcgttttccctttccgttcctccaagaaatctatgcgtttaaataacacctggacaaagcggttgatcagaaaaacaccggcgtaaagcacgagagcgacgatgatgatctcaaccactttgcttttcaaaatatccgtaattgtcgtttccatcttctgttaacctctggcttttcgtaatgaaaaatccgtgtcctgataataactgtttttgacaaggacgttcggtccgaggcaccggacgtttgtgcagcggcagttcagctctttgctcagcttcgtctgtctccacttgtcatatgcatcgggaaggctgtctgttttaatattgccgagcggcggtgtatcgccgaaatccgtgacaatgatatttccgtcaaaaatgttgacattcaggcgggagcggccgtcagggtcgtttcgcaccgtaacgtttttcgcttcccgcaggcggcggaggagcttctggtcttcttcatcagggctgcatgcgtaaaacgggagcgtgccgaacagcatccatgtctcttcatcgcgaatgtcgagcagatgatgaatggcctgtctcatgtccttcaggctgagtgattcaagcgcgctggcgaaatcactcggatacatcggatggacttcgtgccgctggcatttcatttcttccgtaatctgccggtgaatatgttcaatatgcggcagcgtccgcttgttcagcatcgtttccgctgaaaccattacgcctgcttcgaccagcgtgcggctgttttcaatcattttatcaaaatagcgcgcccgctgttcaaatgtcggtttcttctccatcatcgcaaatccgatgtcggcaaagtcctcgaccgttccccaattgtgggaaatgtgaagaacgtccaaataaggaataatccgttcgtagcgcccgatatcaagcgtcaggtttgaattgatctgtgtgcgcacgccgcgttcatgcgcatatttcaaaagcgggacgacgtattcctttaccgatttcagcgaaagcatcggttcgccgcccgtaatgctgatagagcgcaacagaggaatttcatcaagccgctttaataaaaggtcgatcggcagcgcatccgggtctttcggctggagcgtgtacccgacggcgcagtgctcgcatctcatattgcacaaagtcgtcgttgtgaattcaacgttcgtcagtttcatatctccatactggtcgacatccatgtacgcttcccaaggatcgtactccggtgtaatcggacgcagtgctgtgttttgtgtcatgactatctaactcctttataaatgggcatactaacgtctgccaactgttaattttagacctgatctgccaagatcgcaagtagcggaaccattgaaaaacgccaaaaaatacgctaccattataaaaaatgaatggagtggaagtatggggaatgcagtaaacagcaaagatcagcagctcgattacctgaagaacagactcgatatgtttatgaatgtcattgattcattagaccctgaatcaacggacgttgaagatatagaccggctcatcggcatgcttgatgatctggaagcaaaatacgaacgctttaaaaaggattgggaataacccccggcggatgccggggtttttctttttccataatgcggctgtataaaagggcagggcctactgcaaaataaggaaaaatgcagaaggagtgctggtcatgaaatggttttgttcaatttgctgcatggccgttttacttgcaggaggcatcaacagcgcagaagcggtgccgaatgaacggataaactggggatttaaacgcagcgtcaatcatcagccgccggatgccggcagacagctggacaatctggtcaaaaaatatgatgccttttatttgggcaatacgaaagaaaagaccatctatttaacgtttgataacggatatgaaaatgggtacaccccgaaagtgcttgatgtgttaaaaaaacatcacgtcacgggcactttttttgtcacgggtcattttgtgaaagagcagcctgatttgattaaacggatgtcaaaggaaggccatatcatcggcaatcattcttttcatcatcctgatctgacgacaaaaacgggcgatcagattcaagacgaactcgattccgtcacggaagctgtgtacaacattaccggaaagcgggacaacctgtatctccgtccgccgcgcggcgtattcagcgaatatgtcctcaaagaaacgaagcgtctcggctaccaaacggttttctggtccgtcgcatttgtcgactggaaggttaacgagcaaaaaggaaaacaatacgcctatgatcacatgataaagcaggcgcatcccggcgcgatctaccttcttcacaccgtttcaaaggacaattcagaagctctggacgatgccattaccgatttgaaaaaagaaggctacacgtttaaaagcattgatgacctgatgtttgagaaagaaatgaagctgccgcgcctgtagaaaacacctctcctggtaatggagaggtgttttgttatttgatacatttaatcaatgccgcccaatccaaatctccgcagccttgtgcgatcccgctttcaaaatggctcttcgccagttcggcaagagggagttttgcggaaacctgttctgcggcggcgagcgccagattggtatccttgagccctaaagacattttgaagccggccggctcaaatttctcctcagccatgatcgtgccgtaattttgatagacgggagagccaaagagtgcgttggcgatttctagaaattgtttttgttctaaaccgaacttatccatcattaagaatgattcagataacgcctccagcatagaaacgagcaagaaattgatgctgattttcgcggcatttgccgtttttgtttcttcacccgtgtcaaatacttgctgactcaggatgttaaacagcggttcggcctttttcttcgcttctgccggtccggctgtgatgatgcgaagctcggccttctcggcggcatcggggcggccgaggacgggagcggcaataaaggactgccctctgcccgaatgtgcggcggaaagctgttctgacagcgccgtactgatcgtgctcattgaaatatgaatgccgttttcagataacccggcaataatgccgcaagctccgaacgtcacgcctgttacagcttcatcgtctgacagcattgaaagcacaatgtccgcatgttcagctgcctggcggggcgtttcggcatattcggcccctttatccagcaggtcagccgctttttctttcgtccggttatatacagtcaggctgtatccggctttcatgatattttcggcgatggggcggcccatattgccgagtccgacgatggcgatcttcatttgacagtccctccaatgaaaagttttccaccattatacatgcaaaatggttattctgctgtgtacaggattgccactttcagttccggttctgaagaccatccggagtctgaggcggctgtccccttataaaatccggtaaatcgggttttgatgattgtttttgaacggggttttacagtgaatgtttttgatttgaatgtgacgtcctttatgttttctgataaatccggcgtgacagaaatggtttgttccccttttccgtaatgattgatataaagcgtgcagctcatgcccgctctttttcgttcaatcagatgactgcattcgctgcggtgcttcaaatattcgacagactctttttcgggcgcgaactgttttaaggaaaaagcggcatattcggtggcaggactgataccggaagcggcccccatactgagaaagatcagaaacagccccgccgagggaagcgtccgcctgaacgcggcggcacaccagattaacgccgcaaagtaaaggacgaccccgggaatgacggagatatgggctccgtcttcagaccaggaagaaaagccgagcgactcaaagatgtaatcagacaccgtacggccgttatacagcggggcaatggacatgacactgaaaagcaggaggacagaagaaatgattttatgagaaaggatggtaacggcgcacacctctttacgtttttttccagactatcatgttttctcaaaaaaaagaacagccggcagccgttcttacttgaaaatattaaaccagcctttgcgggcgaaccaaaacagcatggcggcgacaagaacggccatgacgcccaaaacgataaaatacccgtatttccaatgaagctcaggcatgttatcgaaattcatgccgtaaacccccgcgatgaacgtcagcgggataaaaatggtcgagacgatggttaatgtcatcataatggcgttcatccggtttgaattcagcgtcacatagctgtcccgcaaatctgacgtcatatcacggtttgactcgatcagctcggccagttttaacagatggtcataaatatcgctgaaatacgccttcgtttcacggctttcttttacatggtcaaggctcaaaatccggtacattaaatcgcgcatcggaatgatcgtccgtctcaggttcaaaagatcagtccgcaattcaaacacttcattcattaaagtgccgtaagatttatgtgttctgctgtcttcaatttcattcagccggtcttcaattttgtacagcacggggaaatattcatcgacaagctgatccataatcatataagtgatgtgccccggcccttttttggctaatcccggagaagcgaaaaaccgttctctcacccttgagacgccgggcgattcgtgcaaatggaagctgacgatgaaacggtcggactgaaagatgtccacctcttccatttccagtgtgtccgggttcaaggcgtggagcacataaaaacggtagccgtcataatggtcgattttcggccgctgcatatgctgaaagcaatcctcgatcgcaagcggatgaaagtgaaaataatcccgcagcagctcggtttcatgcatctcagcgccgaaaaaatcgatccagtaccatgcgatgtccggttgttctgtacgtgataggggatattatctaatatctcattatgtgttgtgattgcggttatatgtatcataaacaaccctccgcctgccattatatcatgcggcgttatgaagaaaagtatacgaattgccgcccgcccgcttcatgatatacttggacaaaaaggggtggagcatatgtggaaggaaacggtttcggtcacgccgccgtatcattttgataaagtccttgagaggctgtcgctcgatccgctgaatgcggtcgatcttcatgcaagatcaatcaaagtgccgctcagaacacgggacggcaaactgtccgtcactacggttcaagcggaaggcaccgccgcagacccggtcttcctcgtcagcggagaaacggaccgcgaggagatgattgaacggatcaaacacatttttcaatgggaacagccgcttcagcctgtgcttgatcatttctcaaaaacaaatctgtcggcgctttttgaggagcatgcgggaaccccgctcgtcttggaatatgacgtctacaactgtctcatgaaatgcatcatccaccagcagctcaacctgtctttcgcatttaccttaacggaacggttcgtccatgccttcggtgaacaaaaagacggcgtctggtgctatcccgagccgaaaacgatcgcggcgcttgattatcaggacttgcgggagctccagttcagcatgagaaaagcggaatatgcgattgacatttcacgcatgattgcagacggagcgctcaatctggcggaacttacccatttatcggatgaagacattatgaaaaagctgatcaccatcagaggcatcggcccgtggaccgtccaaaacgtcctcatgttcggccttggccgcccgaatctgtttcctttggcggatatcggcctgcaaaatgccatcaaacgccgcttcgcccttgaggataaaccgtcgaaagacgtgatgcttcaggtaagcagcgaatgggcgccgtatttaagctatgcgtccttatatttgtggagaagtattgaatgaaaaaccgctttgatcattttttggaaacttccagtgaaaaacatgaaggaaccgccggctgcatgttatactgaaaagatgtgatatttcaaatcagccgctttcccaggagaaaggctttatatagaaacggagagaaaaaaacgtgaatcaacatcaaaaaaaggcgcctgccgaattgaaaatcgggcagacatttccgctgaccatcaaacgtctcggcattaacggagagggcgtcggctattttaagaaaaaagttgtcttcgttcccggcgctctgcccggggaagaagtcgttgccgaagcgacaaatgtgcagccgaaattttcagaagcacgcgtcaaaaacatccgcaagccgtctgaacaccgcgtcacgccgccatgcccggtctacgaccagtgcggcggctgtcagcttcagcatctggcatacacccagcagcttcgcgaaaaacgcgacatcgtcattcagtctctggaacgtcatacgagattcaatgtcgaagaaatgaacattaaagatacgatcggaatggacaacccttggaattaccggaacaaaagccagttccaagtcggacgctcgcaaagcggcagcatcattgccggcttatacggacttgattcccataaaatcgtcccgattaaggaatgcattgtccagcatccggcgacaaacaaaacaacgggtatcgtccgccgtattttggaaaaacacaacgtatccgtttataacgaacggaccaaaaaaggcgatgtccgcaccatcgtgacgagagtcggttttgaaacaggcgaagtgcaggtcgtgcttgtcaccgcgaaagagacactgccgaataaagacgagatcgtcaaagccattcagaaccggctgccggaagtgaaatcgattattcaaaacgtcaatggcgcgcgcacatccgtcattttcggtgacaaaacaaaagcgctggcaggaagacatgccattcaagaagtgctcggtgacgtgtcatttgaactgagcgcccgcgccttcttccagctcaaccctgagcagacggtcaagctatatgacgaagtgaaacaagcggctcagctgacaggaaaagaaaaagtcgtagacgcgtattgcggcgtcggtacgatcggcatgtgggtttcaagcggcgcaaaagagatccgcggcatggacgtcattaaagaatcaattgatgatgcgaagaaaaacgccaaaaaacacggcatcaaaaacgcggcatatgtcacgggaacagccgaacactggctcccgaaatggacgaaagaaggcttccgtcccgacgtggtcatcgtcgacccgccgcgaacgggctgtgacagaacatttttagataccatcaaaaaagtaaaaccgaaacgcttcgtctacgtatcctgcaatccttccacactggcgaaagacttgcaggcgctgtcgaaagactatcgcgtcgaatatattcagcctgttgatatgtttccgcagacggcccatgtggaagctgtggcgaagcttgtgttgaaatcgtctaactaaaataaacaattcgtaatcagacctggatttcggtataaacatttccgatttccggttttttttatgcgcagcctttgccctggctgtttatcttccttcttttctcggagatctttaatttaaactgatgaaaagagttgaaaaaacgtgtggaaaagcgaggagaaaacagccaattttgacctcgtttgtataatgacgctgtggtttattgtgacattaatgggataatgtaaaataatttgatatcattggtttgagatgaagttgtaacattattcaactgtaaagtatttatcatgccaaagtaagtaggtctttaataaatgataaaaaggaggtgaaaccgaacgagagatattgagatttcaacaactgaacgaaggttctgaagtagaagctgtaaaaggcaagggtgctaactttcactaaatcacagcggcagttggcatatcaacaactgtcgataaaagatcaaatacactaaaaaagcatgtttggtcgttatatataatatgaaagcctaaacaggaaaaggaccccaactattcctcttgttctaaaaaaaggaataaatataaggcggaaacgcaagtgataacaactattacagtaatacctgcgatggttatatccttaataagtaattattgcgacaatcatgcttcatcatataatgatgttagattgacactaggctaaaaagtattgcagaaaaggaaatggataaagaaatgggtaaagtatataaaagaagttggtttcacacgttgttggcatttttagtatcacagctttattttaactttgtagaattaacgggatggggtcctaattatagagaaatgaatggattcccagcaaatatagctgaactggatttctttcaaacatatctttcattctatgataatccatggtttaatattgtcactgttttcttgggggttttcactgttatacaaatcattaaaggtataacaaagaatatccgaaatgaaagcaataacttctgatgccttatttaatgatgaaagaacatgaacactttctaattaatcttatgaatgaagactgcggcacttagtcagcagtctattttattggttttggatcaggattaccgaagcgtaaccttatacaaatatatataggtgattgtataaagatattaacatacggggtttaaaagccgatcaacccttagtacatatactgtatagagccaagccacttgcggcgttgattatttctagaccatgagtaaatccgaaaagatccagattgaagttcttgaattctgttaagttcgagtttattttcccatgccatcctctttactccatgtgattcacaagcggcaagttaaggctttttctttttacattcttttcagtactcagatatacccccagccccatttgcttaatcaacttatttcttgaaatttgttttatggtaatagggagaactcatatgatattctatttaggttggaatcctttttatccaaaaagagcaaaagtaaggccgctaagaaagatgaaggtcagcgctaatcttaataaaccacaatataaataaaaattaggtgtagataatcatcacactttttctctctcaaacccttttaaaggtgaaggagttgactgagttgatcagaaataaacgatatggggttgactatagcggtagtctattacgttagctcaattaatgtgttctactccagtttgcttttttacttttaacgtgtaaaaagtgaaatgttcaaaatttactatcgtttgataagaagtgctgacacatgctataagtgtaaaagaagcatggtcagtttttaattttgggataaaggtttcactgtatcccatcatgaaaggatttggatttgttatgacagataatttctggcgtgaattaccgcggccattttttgtactggcaccaatggaagatgtgacggatgtcgtttttcgccatgttgtgagtgaagcaggcagacctgatgtgtttttcacagagtttacaaactcagaaagctattgtcacccggatgggaaggatagtgtgcgcggccgtttgactttcacggaggatgaacagccgatggttgcccacatatggggagataagcctgaaaactttcgccaaatgagtattggaatggcggaattagggtttaagggcctggatatcaatatgggctgtcctgtacctaatgtggcggggaatggaaagggaagcggcctgatttgccgtcctgaagttgcagccgaattaatacaggcggcgaaagcaggaggtctgccggtaagtgtgaagacgagacttggctacacggatgttgacgaatggcgcggctggctgacacacatactgaaacaagacattgcgaatctttccattcatctgcgtacaagagcggaaatgagtaaagtagatgcgcattgggagttgatcccggaaatcaagaaacttcgtgacgagattgcgccggatacccttttgacgatcaatggggatattcctgaccgtgaaaccggcttgaaacttgctgaacaatacggtgttgacgggattatgattggacgaggcatttttactaatccgttcgcctttgaaaaggagccgagagagcatagcagtaaggaattgcttgatcttttgagattgcatctggatcttcatgatgaatattcaaaagcagaagccagagcatataaaccgctcccccgctttttcaagatatatctccgcgggttccggggagcaagtgaattaagaaatcaatgcatgaatacaaagtcaacagatgaagtgcgtgcattgctcgatgactttgagagaaagtatcttgatgggatggagcaagagtgacataaacaactcatcatccggcccggatttcggtttgaattccgggcctttttgtgtgcagcttttacccagacagatccatggccggtttcgtcatgcagaaataaacgaataatggtacattgataggagatacatcataaaggggagagaaaaatgaaacgactgtgcatcatcccctgcggcaagaaaaaaatttgggatgtccattcagatacagggccggtaagggcggaagacgcttatctcagcccgtttcatcaggcatgcgagcgatatgcgaaagcatttttcgatgagtgggtgattttgtcggcgaagcacggatttcttcgtccggatgatactgttcccggaaattacgatgtcacttttggaaccggtcacccggagatcatggcagcggacgagctgcgccgtcaattttatgaaaaaggcttttccgacgtcgaagagcttgtcatgcttggcgggaaaaaataccgaagcattctaaacgccgtcatcggagagcatcagcatatcacctggcctctgtcatcgtataaaggcattggttacatgcttcaagcactgaatcgggctgttgaagaaaaggatgaactgcagcgcgtggatatgaaaaaaagagtgtaaccactcaaacgccgtgatagactgtatgcggaagaatgaagcaataaaagatttccgaggaaataaatacgtcgatcattgtcaaagacagggtgatgcccggtcttttttgtatgccataaaacgagacaaagggaacggatcgagacaaaatgagacacctgtctcaaactgtctccattgaaaaaataaaaacattcattttacgggcttcaaaggctggcatgcttcttgcatttataagtgtgaaccctaaatagaaggaggcgcacaaaatggaattgttaaaacgagaaggcttgtcattaactgaggaaaaagcgctgtggatgtaccaaaagatgctggaaatcaggggctttgaagacaaagtgcatgaacttttcgcgcaaggagtgcttcccggattcgtccatttgtatgccggtgaagaagcggtagctgcgggggtgtgcgctcatttagatgatggcgacagcattacaagcacacacaggggacatggccattgtatcgccaaaggctgtgatctggacggcatgatggcggaaatattcggaaaagcgaccggactgtgtaaaggcaaaggcggttctatgcacattgcggatcttgataaaggcatgttaggcgcaaatggaatcgtcgggggcggatttacgctcgcatgcggatcagcgctcacggctaaatataaacaaactaaaaatgtaagcgtttgctttttcggggacggagccaataaccaaggcaccttccatgaagggctgaacttagcggcagtatggaaccttcctgtcgtgttcatcgccgaaaacaacggctacggcgaagccacgacatttgagtacgcgtcagcctgtgattcaatcgccgatcgggcggctgcctacaacatgccggggtcacggtggacggaaaagatattttagcggtttatcaggcagccggggaagcgatagaaagagcaagaaacggcggaggcccgtctttgattgaatgtatgacttacagaaactacggccatttcgaaggcgatgcccaaacttataaaacaaaggatgaaaagactgagcatcttgaagaaaaggatgctatccaaggctttaaaaactatcttctaaaagaaacagatgcaaataaattgtcagacattgaacagcgagtcagcgaatcgattgaaaaagccgtctcgttcagcgaaaagagtccttatccgaaagagtctgagctgttgacagacgtctacgtgtcatatgaaaaagggggaatgtgagatggcgagagtcataagcatgtcggacgcgatcaatgaagcaatgaagcttgcgatgagaagagacgacaatgtgcttgtaatcggtgaggatgtcgccgggggagcggcggtcgatcatttgcaagatgatgaggcatggggcggggtactcggggtcacaaagggtctcgtacaggaattcgggcgcagccgagtgctggatacaccgatttctgaggcgggctatatgggtgcggccatggctgcggcatccacggggctgagaccgattgccgagctgatgtttaatgattttatcggaacgtgctttgaccaagtgattaaccaaggggcgaaattccgctatatgttcggcggtaaagcgcaagtgccgatcaccgtccgcaccacatacggagccgggttccgggcagccgctcagcattcgcaggcgctgtatggcctgttcaccagcatcccggggctgaagacggttgtgccgtccaatccgtatgacgccaaaggtttgctgctggcggcaatagaagacaatgatccggtattcttttttgaagacaaaacgtcctacagcatgaagggcgaggtgccggaagattattatacaattccgctcggaaaagcggatatcaaacgcgaaggcagcgacatcacgctgtttgcggtcggcaagcaggttaataccgcgcttgaagcggctgcacagctttctgagaaaggcatcgacgccgaggtgcttgacccccggagtctgtctcctctagatgaggaagcgattttcacatcgttagaaaaaacaaaccggctgatcatcattgacgaagccaatccgcgctgcagcatcgccacggatattgctgcgattgtcgccgataagggctttgatttgcttgatgcaccgattaagcggattacagcgccgcatacaccggtgccgttttcgccggtgcttgaagatcaatatttgccgacaccagaccaaattgtcagcgtcacgcttgaattgcttggcgagccggcaatgaattaaaggagggatacagaatggctgtaaaagtagtaatgccgaagctgggaatggcgatgaagaaaggtgaagtatccgtctggaataaaaaagtcggcgacccggtagaaaagggagaaagcatcgccagcatcaactcggaaaaaatagaaatggaaatagaagcgcctgaaagcggcacgcttcttcacattaaagtcaaagagggagaaggagtcccgccgggaacgcccatctgttatatcggggaaaacggcgaagaagtgcgggagaaggaggcgccggctcctgaaaaagcagggaaaccgcaagctgaacctgaacatattcccgctccaaaagccgggcaaaagcgcaaacaccgcgtgaaaatatctcccgttgccagaaaaatggcggagaaagccgggttgaaagtcgatacgctgaacgggacggggcccggaggcagaatcgtaaaagctgacgtcatcaaggcgatgaagacagaagctgaaccgcagtcttcggttcagacagcacagccggagggaaaaccggcttcagcgatgagaaaagtgattgcagaccgaatgcacaaaagcctgcaaaacagcgcccagctgacgctgacgatgaaagcggacattacggagcttgtaaaatggcagcagcagctcgccgacagcgcgaaaaagcggagcggtgttaaactgacggtcacacatttcatatcccgggccgcggtgcttgcgctgaaacagcatcctgagctgaacagctcttatcaagaggagcggatcatcacctatccatatgtccacctcgggatggcggtttctcttgaaaacggtctcgtcgtgccggtgatccgggatgcggaaaagctttcattccttgagcttgcggatcacatcagcacatcggcacgccgggcgcgggaaggcaatgcttccggagatgatctccacggttcgacattttctattacaaatctcgggggttacggaattgagcatttcaccccgattcttaatccgcctgaagccggtattctcggagtgggcgcaagctatgaaacgccggcgtttaaaggagatgagcttgtcaaaagcatcatgctgccgctgagtcttacctttgatcacagagtatgtgacggcgccccggctgcggacttcctgaaaacggtcaaagcgctgcttgaagagcctgccggtttgattttatagagagaggtgaaaaaatgaaactagccattatcggcggcgggccggccggatatgcagctgccgtgactgccgcgcggagaggagcagaagtcgttctgatcgacaaagggccgctcggaggcacttgtctcaatgaggggtgcatcccgacaaagtcgcttttggaaagtgcgaatgtgctcgataaaatcaggcatgcaaatacattcggcatcgaactgccgcaaaacattacactcaattggaaccgcatgcaggggcgcaaacggcaaatcgtcagccagctcgtgcagggaattcaatacttaatgaaagcaaatcagattaaagtcatcagcgggacagcctcatttctcacagagcagacattgcttgttgaagaagaaggaggcgcaaaagacattctggaagcggaccggatattgattgcatccggatctgaaccggcggagctgccgtttgccccatttgacggcgattgggtaatcgacagcaaagatgcgctttctttacagaaaatcccttcgtctctgctcattgtcgggggaggtgtgatcggctgcgaatttgcctctttattcagccggtttaaaacgaaagtgacggtgattgaatcggctgaccggctgctcccggcagaagacagggaaatcgccgccgttttcgaagactctttaagagacagcggggctgatattcagacaaaagccgcccttcagcggattgacaaagaaaggaaaaccgccgtgtggacaaaagacggaaaagaaattgaagctcaggctgatcacattttggttgcaatcggcagaaaaccgcgtttgcaagggctgaatttggatcaagccggcatccggtattctccgcgcgggattgaagtcaatgaccatatgcagaccaatgtgcctcatatatatgcgtgcggcgacgcggccggaggaatgcagctcgcgcatgccgccattcatgaaggaatcacagccgccgcgcatgcctcgggaaaggatagcaaagtcaatatgcgggcggtgccccgctgtatttatacatcgccggaaatggcagctgtcgggctgacggaaacacaggcgagagagacatacggagatgtgaaaatcggagaatgctcattttctgctaacggaaaagcgttaattaagcatcagcacggcggcaaaatgaaaatcattgccgagccggaattcggagaaatcgtcggggtgtcaatgatcggaccggacgtgacggaattgatcggtcaggcggtcatgatgatgaacggtgaaatgacggcggatatgtcggagcactttatcgcggcgcatccgactctgtcagaaacgcttcaggaagccctgctgaatgtcaccggacttgcggtgcattccgtataaccggaataccctttctcagatgagaaggggtatttttcgttgaaagcgctttacttttcccctacaatatatgaaaagatggtctgaacaggggggagcgaatacaatgaatgtcattcggaatgattttaaaacctggaagcgctttgtgaaagaaggcgtgctcgatgaatcccgtattcagaagcgggtggccgcctcatggcaccgctgcaaaaaagccgacgtcaacccttatctagaaaagggaccgaatgtaatgccggcagatcatttagaaaggcaggccgaaaagcatgcgttatttttagcggcctcaatgccgcacgcagaaagaatgaaaacagcgatgcgggaaatggaaatgatggttctcctgattgattcagacggcgttgtccattcagttgacggccacccgcgcaccattcatgaagcgaaccgcatcaatttcttaaaaggcgcccgctggacggaaacggccgtcggcacgaatgcgatcgggacggctctttatacaaatgaaccggtcatgatacacggctctgaacattattcgctcgcttctcatcaatggagctgttccgccgcgcccatccgttatgaagacgggcggctggcgggtgtcattgatatttcctgccccgccgcccgcgctcagccttttatgctcggaattgcctcctccatcgcttatacggcggaacgggagcttgccctaaagatcaaaatgacagaacttgacatgatcagcaaattcgccgggcttacccggtctcatgatccgatcgtgctttgcaatgaaatgagccgggttatcgccgcaagccgtcccgttcagcattttaccggacatatgctgcgcgagcttgaggaacagggctatcatatcaagcggacgaagcgggaggagaacggcttcacatgcgtttacttatccaaacgggaagaaaagccgtcgtttatatttcatggtgcggcaggcaaaagcccgtcatcccgacatatgcttgagcagctggagcttgtcgcccgaacggacgcaaccgtttgtcttacgggagaaaccgggacgggaaaggaggttgccgcccgggcgattcataacaacagctccaggaaaaacggcccgtttatcgctgtcaactgcggagcggtccccgaaaagctgattgaaagcgaactgttcggctactcggaaggcgccttcaccggggccaaacggaaaggacatagcggcgctttgcaaaaagccgataaaggcacgcttttcctcgatgaaatcggagaaatatcacactccatgcaggtggctctgttacgggtgctgcaggagcggaaagtcaccccggtcggcgggacaaaagagattcccgttgacatcagaatcatcactgccacccacactgatctgagacagcttgtcgaatgcaaaaagctgagagaagatttattttaccggcttcacgtctgtccgatccacctccctccattaagagaacgcaccgaagacattcccggactcttccttgaatttcagcgaaatcgcggctggcggggggagcttcctgttgactttttagacgtattaaagagccggaaatggccggggaacatcagggaattgtttaatgtatttgaacgtctttccgtcatgttcccggacggacggctgtcagggcgccccatcgcagccctgcttgaagcgtcaggtcttaaagaagcggccgagtcttatgaacaggaagaagcgtcctctgtctccatccgggagcacattcagaaaaacatcatcgtaaacgcgcttgaatcagcgaaggggaatgtcacgctggctgctaaaatggccggaatcccgcggagcacgttttacaaacgcctcaaaaaattcaaactcaccgccggacaattgtaagaaacaagcatacttctcttgggtgccggacacgttatgtgtgaggactaaaggaggtttgagacgtgaatacacagcgtgcgaaagacatttcggaatccgccgccatggcgtatgtgacgtatgaaggagtcccgatttatattcagcatgtcaacgaagacaaggaaacagccaggatttttccgatcggaaatccacaatttgagcaggaagtgctgctttctgatttacaagagcatttttgagaaggggtctgctgatgacagcaggcctttttcgtacctgtgggaactttcccgctttttgagaaaaataactaaaaatgatcaaatgatctaactccttcaaacccggtacagatcggaccttctcatgatataaataaaatgtaaacgttatcagaggagggcttcacatgacagacaaatcattctcaatcgttattgcaggcggcggcagcacatttacccccggaattgtattaatgcttttgaatcacctggaagagtttccgatcagaaagctgaaactttatgacaatgataaagaaaggcaggagcggattgcgggtgcgtgtgaggtattcataaaagaaaaagcgccggacattgaatttttggcgactgatgacccagagacggcttttacggatgttgacttcgtcatggcgcatatccgcgtcggaaaatatgcgatgcgcgcgctcgatgaacaaattccgctgaagtacggcgtggtcggccaggaaacatgcgggccgggcggaatcgcatacggcatgcgctctatcggcggtgttctggagattcttgattatatggaaacgtactcgcctgacgcatggatgctgaattactccaatccggcggcgattgtggccgaagctacacggcgcctcagaccgaattcaaaaatattgaacatctgcgacatgccggtcggaattgaggatcgcatggcgaacatcctcggattatcttcacgaaaagaaatgaacgtccgttactacggcttgaaccactttggctggtggacgtccatcacggatcgagaaggcaatgatttaatgccgaagctgaaagagcatgtccgtgaatacggctacgttccgaagacggaggccgaacagactgaagcaagctggaatgacaccttcaaaaaagcgcgcgacgtacaggcggctgatccggatacgcttccgaacacatatctgcaatattacttattcccggatgatatggtgaaaaaatcaaatccgaaccatacgagagccaacgaagtcatggaagggcgcgaagctttcattttcagccaatgcgatatgattacgcgcgaacaatcatcggagaacagtgaaattaaaattgatgatcatgcttcctatatcgtcgatcttgcccgggccatcgcttataacaccggggagagaatgctgttaatcgttgaaaataacggtgcgatcgcaaactttgatccgtcagccatggttgagattccttgtctcgtaggttcaaacggaccggaaccgctctcagtcgggaacataccgcaatttcaaaaaggcctgatggaacagcaggtgtctgtcgaaaaactgacggctgaagcgtgggaagagcggtcatttcaaaagctgtggcaggcgctgatcctgtcaaaaacagtgccgaatgcccgtgtggcaagactgattcttgaagatctgatggaggctaataaggactactggcctgagcttgatgtaagcccgtctcctatttcctgatgacaatcttccccgttttctttatctgttattctatataatagaaagaaaacggggggatttttgggatgagtcttgaagaactggttaatcagcattacgcgaaattaaatgacaacgatttttatattttaaaatatatattgaatcataaacatacgtgctaccatctcggtatcaatgacatggcgaaagcctgtaatgtctctcggtcttccatcctgcggctcgcccaaaaactgggcttcagcggctatagtgaattccgtgtttttctgaaatgggaggatcagcctgaagagggcgagaatatgacgtttgaaaagctgctggatgatattgaagccaatgtaaaatacgtgaagtcaaaagatatgacggagatgtgccggctgatagatgaagcaaaacggattttcgtttacggatcggggacggctcagagggtgtgcgcccgtgagctgcagcggatgtttgtatcccggcggaagtatctgattttaattcaggacatcacagagtttaatatcatgtgtgatgattttaaggttgatgacgtattcatcattatttctttatcaggcgaaacacccgaattaattccgcaggtaaggaccctgtccgcaaagggagttccgtttatttcaatcaccaatctgaaaaacaacgtactggcgcaaacgacgccgtataatctttatgcgaccagcaagccggtgacgttaagcgataaaacggaaatcgtcgcatttgccccgttttttctggtgggcgaagcgttattccgtgcatatgttgattataaagagctcgaaaattttgataaatagcgggaggtcacgtgaaatgatgcaaaaagtccagcgcttcggcagcgcgatgtttgtgcctgttttattatttgcattttccggtattattgtcggtctgagcacgctgtttaaaaataaaacgctgatggggccgctggctgatcctgacgggttttggtatcaatgctggtacgtcattgaacagggcggctggaccgtctttaatcaaatgccgctcctgtttgcgatcggcatccctgtcgccttagcgaaaaaagcgcaggcgcgggcttgtttggaagcgcttacagtttatctgacattcaattactttatcaatgcgattctgacggtttggggcggggcttttcatgtcgatatgactcaggaagccggcggaacgagcgggctgacgatgatcgccggcatcaaaacgcttgatacgaatattatcggcgccatctttatttcatctattgtcgtgtatttgcacaatcgttactttgataaaaaactgccggattttctggggatttttcaaggatcttcctacatcgttatcatttctttcttcattatgataccgatttcacttgcggtggcatacgtatggccgatggttcagtccggaatcggatcgctgcaaagttttctcgtttcttccggggcgatcggcgtgtggatttacacattcctggagcggattttaattccgaccggcctgcatcattttatttactcgccgtttatttacggtccggctgtggctgaaggcggtatcgtcacctattgggcccagcatctcggggaatactctcaaagcgtcaaaccgctgaaagaattgttcccgcagggggcttcgcgcttcacggcaactcgaaaatcttcggcattccgggaatcgcgctcgctttttacgccacggcttcaaaggaaaagaaaaaaatcgtcgccggccttttgatcccggtcaccttgacgtccattgtagcggggattacagagccgattgaatttacattcctttttatctcgccgtttttatttgcggttcatgctttgcttgccgcttccatggcaaccgtcatgtatatggcaggcgtcgtcggaaatatgggaggcggtttgatcgaagctgcgaccttgaactggatcccgctggcgtcaagccacggtttgacgtatgtataccagatcatcatcgggctgtgttttaccgctgtttactttttcgtcttccgtttcctcattctcaaattcaacatcgccacaccgggcagagaaaaagaggaagggcaggaaacaaagctctattcgaaaaaggagtacagagaacggaagcaggcttcaaaagaaacggctgcggcagacgaaacacagcgggatacagccgctttgtatattgaagcgttgggcggaaaggacaatattacggaggtcaccaattgcgccacccgtctccgcgtcactgtcgctgatgaatcaaaggtcaaaagtgacgccgatttcagagagctgggagcccacggcgtcgtcagaaaaggcagggcgcttcaggtcattgtcggattaggcgttccgcaaatgcgggagcgcattgaacagcaattggatcaataaggtcaaaaccttcccctccccgggaaggttttatctttttcgcagattattgaaaaaacggcacaccaaatttctttattcatttgccggaaaggcataaaataataatattgaacaaaggatttggaggcttacacatgtcaaaggctttatcatatgtaaaaccgtattcccttttggcgggaatcgctctgtttttcatgctcatcgagcttgcggtagagctgatacagcccctgctgatcgggaaaatcattgacgaaggaattttaaagcaggatctcggtacggtttggctgtggggcggggtgatgatcggactgaccgctgtttcattcgcatcgggaattttaaattcattctactccgcccacatcagccagagctatgcgtatgatacgcgaaaagggctttttcaaaaaattcaatccttctcttattcgacgtttgcgcaattctcatctacgtcgtttatcaccaggctgacaaacgatgtgacgcaggtccagaatatgcttttcatgagtctccggtttatgctcagggcgccgttaatgattgcggggggcattattctctcgctgaccgtcaatgcgaaactcggtttttttctgctgatcacggtgccggttttgcttttgtttttgctgtgggtgctgaaaagaggcggcgcgctgtttcggtccgtgcaaaagcggcttgatcaggtcaacacgatcatgcaggaaaacctgacggcgatcaaactgattaaagcgctcctccgtgcaaaccacgaagtgaaacgttttttgaaatcgaatacgaagctgatggaaaaaacggtttccgcttttcgtctcgtggaagcggcgatgccgattttaatgctgctgatgaacagctgcattttgtttatcttatggttcggcgccaaaagcattgctcagggcggagcgcaggtcggcgatgtcgtttccgtcattaactatgcgacgcggattacaggcgcgctgtccgtcctgccatttctcattatggtattttcccgggcgaaggcttccggggaaagaatcggcgaggtgctggaaacagaaggcggcgagggaacggggcacgacccggcgcgggcgcttgcaggcgggattgagtttcgcgaagtgtccttccgctatccggacatggaaaaagacgcgctgcatcacgtgtccttttcagccagcccgaaagaaacggttgccattatgggcgcgacaggttcagggaaatcaacgctttttcagctgattccgcgcctgtacacggctgattcaggcagtattttcatagacggcaaaccgatcggtgaattctccgcttgcgggctgcgcagggaaatcggctatgtgccgcaggaagtgcttctgttttcgggcacaatccgtgaaaatatcgcctggggacgggaggaagcttcactagatgaagtaatggaagcggccaaagacgcgcaaatccatgacacgattatgaagctgtcaaacgggtacgacacggtgctgggacagcggggcgtcaatttgtcaggcgggcagaagcagcggatttccatcgcgcgcgcttttatcagaaagccgtccctcctgctgttagatgacagtacgagcgcgctcgatcttcaaacggaagcgaagcttttacaagcgatcagatcctatgaatgcacgacactgattattacgcagaaaataaccaccgcgatgaaggctgacaccatcttattgcttgaagacggcgaattgctggcaaaaggcacgcacaaagagctgatggcacagtctcatctgtaccggcagatttatgaatcacaattcggaaaggagggagctgacagtggagaaagacattcgtaaacctttccgatatccgaaaataccgctcaaatcaaatgaaggcggcagaaaacgcgcgaaagcaaaagatacaaaaggcacgctgcgcagaatctggtcgtatgtagccgagaaaaaagggcttttaacccttgtgatcatcatggtagtcataagcgccatattcggcctgctcggaccgttcgtcatcgggaaagcaattgatcattttatcgtcggacggacgacggacggattggcgggtgtactgttcatactgtttgggatttacctcgtgcaatcattgtccttatggtttcaaaactattggatgatcaatatctcgcaaagcaccgtgtttaaaatgcggagcgagctgttcacccatctgcatgagctgccgataccgttttttgataaacagcgcctcggcgatttgatgagccgggttaccaatgatatcgaaaatgtcagctccactttaaatacatccgtcattcaagtgctgtcgagcgtcattacattcgtcggcacaatcgccgtcatgctgttcatgagcccgcttttaacattgatcacgcttttgattattccgatcatgcttttgagcattaaatggatcaccaaccggacgggactcctgtttaagcagcagcagaaaaacctcggcgagctgaacggttttattgaagagtcgatatcaggagcgaaggtcattaaagcctattcgagggaagaccgcgtcatggagcaatttttagaaaaaaacgcggcgttacaatcatcaggcttttgggcgcagacaatttcgggattcattccgaaagtcatgaactctttaaacaatttaagctttacgattatagcggcggtcggcgggctgtttgcgctgaaggggtggatttcgatcggttccattgtcgtattcgcagaatactcgcggcagttcacgcgccctttaaatgatttggcgaaccagttcaatacgatgttatcggccatcgccggggctgagcgggtgtttgacgtgctggatgaaaaagaggagcgggaagatgaagagcatgcgacgcaccagccgatcaaaacgggagagattgaattccgagatgtctccttcggctatcaggaagacagcccgatcttaaaacatctgtccttcagcgttccgaaaggacagtcaatcgccttcgtcggaccgaccggagcgggtaaaacaaccgttacgagcctgatcgcccgtttttacgagcccaataacggaaaaatcctcattgacggaacggacatcaaaaaactgacgaggtccagtctgagaaaaaacatggggtttgtcctgcaggattcctttctctttcagggcaccatcagggaaaatatccgttacggccgtctggatgcatctgatcaagaggtggaggcagccgcaaaagccgccaatgcccacggattcatcgaacggctcccgaaaggctacgataccgtccttacccaaaacggcgcgggcatcagccaaggacaaaaacagcttatttccatcgcgagagatgtgctggcggatccggtgctgctcattttggatgaagcgacgagcaacattgatacggtgacggaagtgaaaatacaagaagcgctcggccgtttaatggcgggcagaacaagcgtcatcatcgctcacaggctgaacacgattcaaaaagccgatcagattcttgtgctgaaagacggcgaaatggctgaaaaaggaacccatgccgaacttctcagccagaacgggttttaccgggaattatatgagagccagttccgggaatcataggtagggaaaaagacctccgacagagtgcggaggtcttttttttgcgaagacaaatagtacttttaagttattttcgttaaatgtaacaaaattacttgacgtaaataagttatgtatatatactagcttacataaagtaagtgataataattttcaaggaggattttatgaataaatcattcgaaacaggaacactgcttttaagggttgtaacaggtattatcttttttgttcacggtttatccaagtttcaagggttggaaggaactacgcaatttttccagagcatcgggcttccggcctttatggtctacgtcatcgcgacgattgagcttgtcggcggggtactgatctttttcggtttggcgacgcgcattatcggcgttctgtttgccgtcacattagtcggcgccatcttcacggcgaagctttcctcaccatttatgggcggatcggaatttgatttcatcttactggttgcgtcaattcacttagcgctttcaggaagccgtctgctttcattggatcagctccttttcaaatcaaaaaagggagaaactttttcagcataagaaagaaggcgttcaaatgaccggcattcatcaagatacagcaatcggttatgtcaaattgacgattaaaaatatggaacgctcgctcggcttttatcggaatgtcatcggccttcaagtcatctcgcagacagatcgttctgcagaactgtcagcagacggaaaacgcgtcctgctggtgcttgaagaaaatccgagcgccgtcgttctcccggagcggtctgtcaccggcctttaccatttcgcgatacttctgcctgaccggaaagaactcggcatcgcattggccaggctgattgaaaacggcatcgcgctcgggcagggggatcacgcagtcagtgaggctctttacttgtctgatccggacggcaacggcattgaaatatacgccgatcgtccccgcagcacgtggcgccgggatgcagagggcaattacgtcatgcaaacggcgcccgtcgatgtggacgggcttttggaagaagccggagctgaacggaaaagccgtctcccggaaggaaccgttatcggccacatccatcttcatgtgacggatttacaggaagccaaagcgttttacaccgatatcctcggttttgacattgtcggcaattacgcgggcatgtccgctctgtttgtttcggcgggagggtatcaccatcacatcggtctgaatatatgggccggaaaacatgcgccgccgaaaccgggaaatgcaagcgggctggattattacaccatcacgctgccgcatcaaaaagagctgtcacgtgtgacaaaagcgctgaccgatgccggctttgagatcgaagaaagagaagagggcgtattcgtcaaagaccctgtatcaggggcggatatcgcatttacactgtaagaaacaacccttgccgtctaaccggcaagggtttttatttttctaaaggctcgggaaagaagaacgtcgatttgcaatatacacccggcttttgtgtgactgaagagagcgaacatctcagtgaggcgcaaacatgacgcgtggagcccgccatcgccggcccgaactcagggcatccgctggattgaaaatgggtgtccgttcggcggatcagggagctgtatgggcagactttgaatagaaaaagggaagagccgcatccggtcacaagatgcggcttttcatatacaatttacaattgtgtgaaaaatgcccaaaataaattgtacttcctgattcttcctgatatgataagccgaaaaaggagaacctccacaaatgaattcaaatgcagcacagacggaacagtctatgaagcataacggaaaccggatgacgttcaaggactttatcattcttgccaaaccggggattatcatctcaaattcactcgccgcattaggcggattttggatcgcgtggcttcagtcggaaaggacggacggagggcccggtatatttgccgccatggcggctgccatgatcggcacggcgttagtcatggcgtcaagcactgtttttaataacttctttgaccgcggcatggacgcaaagatggagcgaacccgcacccgcgccagcgtcacgggaagaataccgccgacggtcatggtcctgtacggcacatgtctcggcgtatgcggattcatcatgcttgcttcgcttaatgtactgaccgccgttcttggcctgcttgcatttttgctgtatgccgtcgtttatacgctttggtttaaaagacaatccgtctggagcacatttgtcggcagctttccgggggcggctccgcctttaatcggttattgcgcgctggccgggtacattgatatgcccgcgattttgttatacgcgattatgtttttgtggcagccgccgcatttctgggcgatcggaatcaggcgaaaggaagagtatcgtgccgccggcattccgcttttgccgatcataaaaggcaatcgcgtcacaaaaataaaaatgctgcgctatatcgccgttttgactgcggtttcgctgctcgttcctctttatatagacgtcagcccgttttataccgcgtccgctctcctgctcggggccatctggctgtaccggagcgtcaaaggctttcaggcggcggatgacacgcaatggtcgaaggggatgtttttttattcgattgtttatttcagtctgctttttcttattttaatggctgattcgtttatcaatgcggtcctcagaacgtaaacaggcggcctgcagatacagagccgccccgttttgtttatgcttttttgatgagagccaaaatatcttcaagccaggaaatataattccgttcccgctcaagcgcttttgtcagcacgagataatggccgaaatcaggagaagaaaatgaatccgcctccgcggacgatgtcatcagttcttgataactgttttccagatcggacaatttctcctgccgctttacgagctgatcggtgaatagctcatccgcttcttcctgcgtcaaagctgagatgaaataagccttcagcataaattcatccttcaccgtttccggaatcgggtcttttttcgtcagccaggcagcaagctccagctctcccttgtcagtcagcgtgtacatttttttctcaagcttcgttccttgaatcgcagtgcgaaacgtaataaatccctcagccgtcagtttttttaattccggataaatctggctgtgctttgcgctccaaaactggccgagctcttccttaaaatagctcgatatatcatatccgctcaattcgccttttcgcaaaagccctaaaatcgcgtactttaaaattctcatgttgtcctccaagcccattcatttgacagctagtataccatacggccgctcaaaaacgcagaagcaccggatgcttatcattgaatccgcggcgccaaaatcagcaaaaatatgcagaaaggggttatcgaaacggcagcagaactggaaaaagcctttctcgtgtctttgcctcattcatatgacatcatgatataatcattgtaaaaattaataaatactgggagggacatatgaagacggtgattgtgtatgcaaacccggatgagaacagtttcaatgcggctctcgtaaaatacgtcgccatggctttaaaggacagcggccaaagctatacggtcattgacttatacgccgatcaatttgatcccgtgctgaagtacggcggcgaaaaaaagcgctctgacatgaaccgggacgctgaaacgaagaaataccggaaactgatgaaagaagcggatcatctcattttcatctacccgctgtggtggggaggcgttccggcgattatgaaaggcttttttgacagagtgcttgtcgccggagaagcctacacatatgaaaacggccgcgtaaaaggactgctccgggcagagacggcacaggtcttttatacggcggactccccgggctggtacttaaagtggttccggaaaaactcggactggattacgctgaaaaaaagcattctgcaattttgcggcattcaaaaagccgagcggaaccttttttctgtcgtcagaacgagcacacccgaactgcgggaaaaatggctgcgccaagcatacgccaaagtccggcgcgcttgtgaaaaaggagcggccgcatgcagataaaagaaattttcgtgattcgctgcctgtcctgtttaagtgtcgttctgcttcacgcagtttcaatggtgctgatgattcaggaagagtccttagccagtgccgcccatacggttgatgcgtttcggaccctcttgatgttcagcacgccggcgtttatctttatttcggaatttctgcttgccaggtcatacccgaaaggcgttccagcgggttttttaaagaaaaggggcaaagtcattttcgtgccgtttctgtttattgccgcggtggatgccattttaatgaaaagcgtggcggaagaaggagccggattcgtttcagtgatcggtaaatttttagaaaatgtgtttttaggaaacttcatcggctacttcattcttgtgatctttcaattttacattctccatatgctgctgcaccgctggctgaacaacacatcccccgtgtgggtgctgtctgtttcgtttatcatcaacgccgtctatctggcttacttttccatctttcatccgccggcatcatcggggcttgattctatttttccgttcttttgggttccgtttccgggctgggtgttttatttctgtctggcattttattgcggaaaggaatatccgcgttttttatcgctcatcaatcagtaccgttatgcggtttacttcagtgcggccgtatcggcaatattgattgtggccgtttcatatatcagcggcggctccatttcctctaagcgtccggatattatgatttacgcggtcagtatgatctttctgtgttttcatctgttttcaaagctcaaaaaagtgcccgcgattgtgatgatgatcagcaactattcgttttcaatctatctgctgcactcctactttttaatcagcggatatcttctggaaggctatttgcggtcaatgcctttagcggctgccatccttcttttatttttgatctgcacgctaggtcccattttcgtatcgtgggggtgcaaccatttcagatacggatacctgtttgtcgggaaagtgtatcagccgaagcagaccaaaagaaatacggcggcgcatcaaggccgcacagtctgaaaaaaaggcggcgcttcggccgcctttttgatacgggtccgctttatccggcacgaggacggatagttgtacatcctgcatacaaagccccgcctgcggctgttttgacggatgcatttatgacaaaataacgccaccgattttctcccttgtgaagaccgatatattgtatacttataggaaatactttcaaaaaaagtgaaaaagagaaaaactgtgagcttggatgaacgactaaaaaggagcggggacattatgaatgactgtgtcaaaacattcggagaacttccggccgaactttattcctttgcgggaggaaaaggaagcattctctctaaaatgtatcaaagcgggtatcctgtgcctgaagggtttgtgattttgccgtcagcctttcaggacggacagctccgccatcaggcgagagaggctgttgatcaatatgtgaattccatccgcagccgccatgcatctgcgttgtttgccgtacgctcatccgcgctgagcgaggattccgctcaggcttcctttgccggagaattcgatacggtgttgaatgtcagaacagatcaagacatgtccagggcgattgatgaagtccgccggtcggtacagtcagaaagagtaaaagcgtacagcgccgttcagggaatggaagatgagcatgaaatcgcaatcgtcatccagctgatgataccgtctgagatatccggagtgctgtttaccgcagatccgattacggggagcaggcgggagatgacaggcaattacgtctacggtctcggggagcagctcgtttccggggaagccgatgcctattcttttaaactggcacggcccaagaaaaaatatgacggccccggggaatttcgcaaatatgcgtcaaagctctataaactggcgaaaaagctggaaaaagatcttggagggccgcaggatattgaatgggccgccgcgggcgggacattgtatattcttcaatcccgcccgattacgaccttacaagccggaaatctggaaacctatgaatggaacgattctttcagcggtgattttttatggacaaacacaaatataggagaagcgattcccgatgtgatgacgccgctgacatggtcgctcctccggaatctggatgaagagtcgggcatcattccgggctattatgtctggtccggcaatatttgcggcagagcctataacaatatgagccagcctctttccgttctcgccgctttcggtctgaatccgaaaggcggaaaaattggaaaaatgatgagcgatacattgggagaaatcccggcggaaatgaagatacctttatatccgttctcaaagtatgaattattgaagatcatcccgaaaaaactgaaaccgtatctgtcgaaaatgaagcaagcgaaaaaaacatgtcctcctacttggacgaatcaccggagtggtgccggaatattgaggaaaagctgaaacgcgccgaaacggagcaggcattattagcgatatggaacgatgagatctatccgtatttatgcaacgcgtggtttgcgttaatatccggcgggcgtgattctgcgcaatcctcttcgtcgttaacctctcaattaacaaaactcgcaggcatagaagatgcgaatctcctgctttccaatctgaggggaaaaggcggactggccagcctggagccgattatcggcattgatcaagtcatgaaaggccgtatgagcgaggaagaatatctcaggaaccagggccaccgtggcccgcatgaatacgaactttccataccgcatccgggagaaaaccgggattggctgacgaagcagatcaaagaacacaaggagtcgggtattgatgccgaacaactgcttttgaaacagcagcgggcgcatgaacaggccttccgaagatttgaaaaaaagtttcctcataaggtcaaatggctcaaagccaaaatggaaaaagcgtcagaatacgcgaatattagagaaacaaccagatccgaatttgtcagagtgtaccggacagccagagcattcgcgctcagagcggcggaaatgaccggcatgaaggacgatattttcttcctgtatctgcatgaaataaccgatctgctcgcggggaaagagccggcggttgcgtcgattcaagcgagaaagcaaaactatgaaacctataaaaaactgccgccgtttccatccgttattaacggaagattcaatccgtttaaatgggctgaggatcctgacagaagagcggattattacgatgcttttatgcctgcggaaacggatgatgcgcatactttaaaaggtttcgcgggagcggccgggagagtggagggcattgtccgtgtccttgatgctccggaagacggtgattcttttgcggcgggggaaattttagtgacgtcgacaaccaatgtaggctggaccccgctttttccaagagcggctgccatcataacggacgtcggcgcccctttgtcccacgcggcgatcgtcgcccgggaactggggattcctgccgttgtcgggtgcggaaatgcaacgtcaaaactgaaaacgggggacagggtggccgttgacggcgggcaaggcatcgtccagctggaaccgcggcagactccggtcacttctgaagaggaaaatggtaaactgatagaatagaatcatgagaaaggagccgcgcatgaataaagcagttattaacggggagcaaatcagaagtatgagcgacctgcaccagacattgaaaaaggaacttgcccttcctgagtactacggtgaaaaccttgacgctttatgggactgtctgaccggatgggtggagtacccccttgttttagaatggagacagtttgaacaaagcaagcagcttacagaaaatggcgccgagagtgtgcttgaggtctttcgtgaagcgaaagcggaaggctgcgacatcaccatcatactttcataatacgagcagcgggagagagacaaaaatggaaaaacaaaccctcagccatccgattggagagtatcagccggctgaatcgatttcggccggacagaaacaagaatggatcaatgcgctggaacacgctccggctaaactgaaccaagctgtcagagcgatgtcggccagtcagcttgatacgccgtaccgcgaagggggatggactgtccgccaagtggttcaccatctggcggacagccacatgaacggctatacccggtttaaattgagcttaacggagaatgaaccggaaatccgtcctatgatgaaaaaggctgggccgctcttcatgattccaaaaccgccgcttgcggggatgcgcttgagctgttaacgatcctgcacagaagatgggccgctcttttgcgctccatgacggaagcccaattcaaacggacatacttccatcctgtatctaaagagacggttacgctggaacaggcgctcgggctatatgtctggcactctgaacatcacatcgcccatattactgagctttcccggcggatgggctggcatctgtcttagaggatgccggcttccggaaaaacgccaaaacagccgcagacacaatcgtgcataatgaaatgacggcggctgccgtataaagatggtggtagccgctggaaatgcccgcttcaatcgcatcagaaaccgcttttttgacggcgggaacggggattcggcttacctgctcctgcaacgaagaaagtccgccgccgatatcgggcgtttgcgcctgatcagcgggaatgccgcttttcgttaaacggtttttaatgtcctctccgatccggtcaaagcccgctgtaatgaagccggcatataaagccggagcgagcgtcagcccgacctgtcttacgagtgacagcgtgccgagcgctgttcctttgttttggcccgccgtttctgatacaagcacattcagcggagccccgagcagaaatccgaaaccgatccccgcaatgacactcgccgtgacaaattcccatttatccgtcacccataacggaaacaggctgaagcccgcaaaggcgatggcgcctgatacaaccgcggagaagaccggtccttttttatccgtgaccgccccgccgagccacgctccgatgcctgacgccaacgcaagcggcgtcatccaataacccgctttctccgccgatacgtgtaaatattgctccgcataagaaggaataaaaatgaccgcagcgagcagccctcccgataaaaatccgatgacaagcgtccattgaaacactttattttgcagcagcgagtaggcgagaatcggatcgcccccgcggtattcaacccgcttttcgaccttaagcagcaccagaaagagaagtgccgctcccaaaagatacccatacacctttacgtccattatgctttctgacagcttcgtcccatcgagattcgtgataccgatcatacaagataagatcgcaagagacagcagcattgtgccggcgagatcaagccgtttcgcctcaggctctttcgtttcagcgataaacaaaccgccgcacacaaccaaagcggcggcaatcggcaggttaatcaagaacagccaatgccacgatccggttacatcaagcaaaaagctcccgatattcggtccgaggacggccgccataccgttcatcgcccctaaaagcccgagagctttcccctgtttctccttcggaagcacggccagcacatgcgaactcccgattataaaaattccgccgccgccaagcgcctgaatgagccgtgccgccaaaaacatcgggaagctctgactgagtgcgacaagcaaagagccgagtccgaacaggccgacttccatcataaacagttttttccgcccgtatcggtccgacagcttgccgacaatcggcacactgacactgagtcccaatgtgtaaagggtcactccccatgatccccatgaaggagaaacatcaaaagagctgttaatcgtcgtcagagcagcggaaataattccgttgtccagcgccgccatgaacacaccgatcgtaaaaagagtgatggcccggctctggtttttttctgtttgcaatggatccggcatactgatcaatccttccttttttaattcacttcgaatatattattcacttcaagtgaattaaatgtcaaacaaaaaaaggccgccgataccggcaggcctttttcatctctatgcctgtttggaagaatcaagggctcttgccaagatggcaagtccttgattgaccgtttgtttttcttcagcggtcagcgtttccaatgaacgcttcaattttacatgtcctttttgataaaggctgcggaaaatatctttcgcgttttccgttaattgaacgacgactgaacggcggtcttcttctgacggagcgcgtgtaatgaaacatgatttttctaaacggtcaaggagccccgtcgtatttgaaagagaagcgcccattttctccgctatgtcactcaccttaagcgtcccgtggttgttcagaagcatcagcaccttcatttgcggcatgctcatatcaagcttcatccactccgacacatcgccgagtcccgccgaggtcatcactttcatgtacagcacccaaatatcccgttcctcaggagaaaaaatatcgccgcctaataccgttgtatcatgcagattataatccatcgtctcacttcctcattcatactcctgcataccatattactgattttaatcagagaaagaaagttgcagacgagttttgtttgaatgtgaggtggtagtgtataatatgttggagattattgggggaattataataaataagctattttatgatgattggagagaacattgctgactaaaaagaatgccttatcgatattaaaagtattatttcctattgcagttttgcttttagtcatttatcagtccaaaaaggaattgacagacctttcttttaaacgaacgctgtatattattaacgggattgagcgttacgatttatttattctcgttctgctcggtctccttgccgtcagcgcgatgtccttttatgactttgtgctgaaacggacgcttcgcctcgacattccgaattggaaagtattcagggtctcctttatcgccaattcctttaacaatgtccttggattcggcggtctggcgggcgtcgggctgcggacgatgctttacaaagagcatacgaatgacgtaaaacgccttgtcgcaggcatcgcctggcttacgtcctcagcgctgctcgggctgtccgtcttcagtatcctgaccattgcccgcattctgccggtcggagagattacaggtgagaaaccgtggctgtgggctgtaatcgccggagtggcgcttattgtgccggcagccttaatcgccgcttgggtcaacaataaaaaagctcgcgcagaagacggtgaagcaaaaccgaggcatccggttttttcttacatcggggcatcgtttgccgaatggtttgcggcggccgtcgtcatgtattattccctgtatgtcatggggattcacgcggatgtccgccatgtattcggtgtatttgccattgccgctatcgggggaatcatcagccttgtgccgggaggattcggttcgtttgaccttctgtttctgctcggtatgcagaatatgggctttccgcaggaggcggttgtgacatccatcgtcatctaccggattgtgtattcatttattccgtttgtgttcgggctgttctttgcggccggcgatttaacggaaaatacgcttaaacggctggaatcaaatccgaagatggcgcccgccgtggaaacgacgaacgtgcttctcgtattccagcgcgccatcttaatcagagtgctttacggttcgctgtcgcttttagttttcatggcgggagtcgttgtgctggcatccgtcgccctgccgattgacagggagacggtcatcccgcatattccgcgcccggcgctccttgcgtttaacgcgttatcgttaagcgcggctttgattcttttaatcttgccgattgaattatacaaacggacgaaacgttcttattcaatggcggttgccgcgctggtcggcggttttgtgttcagttttttaaaaggattgaacatcagcgcgatctttattctgcctgtcgtcatcgtattgctggtgctgttaaagcggcagtttatcagagagcaggcatcgtatacgctcggccagatgatttttgcggccgctctgtttattatcgccttgtttaactacaatctcattgccggctttatctgggataaaatgaatcggctgctgcgccacgattatttcgttcataacaattcgcacattacatatgccacgatgacggccattattgttgtgccgctgtttttcctgttgtttacggtcttttatcataaaagatcgaagccgatcggagaaaaggccgaccctgaacggctgaagtcctttttggcggaagaaggcggaaacgccctcagccatctcggctttctcggggataagcggttttatttctcaagcgacggcaaagcgcttttattgttcggccagatttccagaaggcttgtcgtgctcggtgatccgtcaggacagagagactcttttccgcttgtgattgaggaatttctgaatgaagcgcataagcaggggctgagtgtcatgttttatcagatcgaacgtgaagatctggcgctgtaccatgacttcggctataacttcttcaagctcggagaagaggcgttcgtggatatggaagcatttacgctgtcaggtaagaaaaaagcggggctgcgggcgattaacaacaaatttgaccgcgaaggctacacatttcatgtcggggaaccgccgttttcctccgagtttatcgccaagctgaaagacatatcggacgaatggctcggaccgaaaaaagagaaaggtttttctctcggtttcttcgaccgggattatctggaacaggcgccgattgcttacgtgaaagacgcggaaggggagatcatcgcttttgccaacctgatgccgatgtatcaggaaggcgagatatcagtcgacttgatgcgttatcggaaaagtgcgccgaacggtattatggacgcgctttttatccgtctgtttctctgggcgcaggaaaaaggctataccacctttaatatgggcatggcgcctttgtcaaacgtaggaacggcttttacatctttctggtcggaaagaatcgcggccgtcattttcaacaacgtccggtatatgtacagcttcagcgggctgcgggcctttaaagaaaaatacaaaccggagtggcgcgggaaatacttggcgtaccgtaaaaacagatcgctgtccgtcacgatgattctcgtcacccgcctgatcggaaaaaccaaaaaaagacgccgttaaaaggcgtctttttttttgaagaattaactaaaaattctaattttactctgttatactgaataacatgatcataaggtgaaaggaaggctgatgaatgaaacaggcaaccgtgtttaaatatgaagcgtttaccgatattcctgttttgggaaatcccgcgggaatcgtctttaacggagatgattattcagatgaagagatgcagatgatcgccgaaatggcagggtacaatgaaacctcatttctctgcaaaagcggagaagccgatctgcgcatccgctattttacacccggccacgaaatgaatttatgcggacatgctaccgtcgcctctctttacgcattaattgaaaagggaaggcttcaggctgatcagacatatcaaattgagacaaaagccggtattcttcccgcaaaagccgctgaacgaaacggccgggtatacatcacgctcgaacaggcacccccgcaatttctgccgtttacgggagacaaagaaaagcttgcggcctcgctcgggattacggctgaggattttcacagcgagctgccgattgtttacggatcaacggggatctggacactgattgttccgctgagatcacttcaagcatcacggaatatggtgccggacaacgcacaattccccgctgttttgcgcgatcttccgaaagcgagcgttcatccgttttctctggaaaccgttcatccggaaagtgatctgcacggacgccatttttcttcccctttctccggaacgaccgaagatcccgtcacgggaaccgcttcaggcgttatggcggcctatatgcggcaatacggaggctctgaagccgaatgcctcacgattgaacaaggccaggaaatcgggaaagacggaaaagtggaaatcaggattacagaagataacgaaaagatgaaaatcgagatgacgggaacggccgtgtatgccgaatcaatcaattttcagcttccgtaacggtttacaaaagacggtcgtatccgttatattataaatgataatcattttcaattgaataggaaggtgaatcggcatgccgaaaaccgaacaactacagcaaaacgaaagtcttgcacatacaatcagaaacagaagatccatccggtcgtttaagccggaaaccgtaccttctgaagtcatattagatatgcttgaaacggccgtttacgcgccgaaccacagactgacggagccatggcgttttatctacgcagcaagcgaagcgggtaaagaaaagcttgcggacagctacgtctcatttttcaaaaaaataaaagatgatttcaacgaggaaaaagagcggaacatgagaaaaaacctcagcgccgttccgggatttttgcttgtcgtcttaaaagaagatgaaaatgaatttacgagaaacgatgatttcgcggcgctgagcggcatgattcaaaaccttcagctgctcgcacatgaaaacggcatcggcatggtctggaaaagcggccgcatcatgtatgacaaacaggtgcaccaagacttcggtctggcagacaatgagcgcttcgccgccatcattcaaacgggctatccggatgaacagcctaaggcgaaagaacggacgccggcaaaaagcctgtttaccgagttgtaaaaaaatccccgtctctatacagaggcggggatttcgtattagcgggttttgcttttagctctgttgtcagcggctttcatccgcgcctgcgcttcgcggtcagcggaatcagcaagctcgcttgaatattcctcgtacgtgccgtctgtttcgcgtttcaaagcatccggaacttgaggaagtttttgtttgtttttatcacggtttttgtgagtatgatttctgcccatatcaatcgccccctgaaaaaagtgatatcaaacaaacatagtatctgcccggccccgatctttattcagtttatttccgtttggctgctctttccgcttttttaaattcaccggaataaaggacttcctgcatttttttcagattggctccctgctgatgtttttcgcgcttcttttccataaaagaagaccctccttcaaaacagaataccaataggattggcttttatttccgtttttatgcagataagatatcctttaaagccaactcaagttcttcatacgtaaactgaaaaccggatgtcagcgcctgcttaggcagggcgcgctggccttttacgatcagcaggctcatttctcccaaggccttctccagaaaaaattccggtacgggaatccaatggggcggtgcaggacgcttgcgatcgtctttccgaattgcttcatttctacgggattcggcgatgtcacattcatgggaccggacaagtcatcatgctccgccgcaaaagcaataagttccgcggcgtcatcgacatgaacccatgacagccactgccgtccagagccgacggtgccgcccgctaacagcttataagggagaaccatgagcggcagggcgcctttttcaccgagcatcacgccgaatctggcatataccgtccggatgccgagcgcttcaattttctggccttcacgctcccacatatgagccgtatgactgagaaagtcttcatttgacgtatcggactgctcagtgaacgttttctctgtgcttgtgccgtaaatgccgacggcgcttgcctgaatcaaagcccggggttttttcggctgctgcttcataatccgtctgacttctctcgtcgcttctattctgcttgaaatgatttgttccttcgttgtgtccgtccagcggtcaaagatggatttgccggcgaggttcacccatacatcaatagggggaagctcgcgctcaggcgccgcgttttcggccagccattgaacatatgtcacatttttttgttcggtttctctctgttttcttgataaaatatagacatgatgtccccggcgggtaaacacacctgtcagatgccggcccagaaaaccagtgccgcctgtcatcgcgatattcatatccatctctccttacacgttgatacatatactgtacctcatttgccaaaaagaaaaacgcctgaacatcggggcggggaaggagaccgggatgccgtttattacaaaaatatcgacccaaaagaaaaataccgagcgcttcaacatctttcttgatgagaaatatgcattcagcgtcgacgccgacgtgcttgtgcgttttgacctgaaaaaagggaaagaactggacgagcttgacattcttgaaatccagcacggtgatgacgtgaaaaaagcctttaaccgcgccgttgaatttttatcatatcggatgcggtctgaaaaagaagtccgggatcacctgaagaaaaaagaaacaccggacatggtcatttctgaagtcatccataaactgtacgattaccgctacttaaatgacaaagaatttgccgaagcctatgcgagcacccacaaaaaaacaaacggcaaaggccctgacgtcctgttccgcgagctgaaagcgaaaggaatagacgacgataccatcaaggagacgctcagcgcgtttacatttgatgagcagatacaagaagcgctgaaacatatcggcaaaatcctcaaaaaagacaaaaagctgtccacaaaagagatcagacagcgggcgcagatgcagcttcagcgaaaaggtttccctttcgacgtcatcaatgccgctctggagcagacggagtatgaaaatgatgatgaagccgagatggaagctctgaaggctcatgcggaaaaagcgatcaggaaataccgctatgacggcagctatgaaagcggaatgaaggtcaaacagtacttattcagaaaaggattctcgattgacgatattgatcaattcttgcaggaagaggagtaaactgaaatggacaaacgatacagtcaaatgacgcctcatgaactacagacagaaattgcgggactgacggaaaaagcgcgtaaagcggaacagatgggcattgtaaatgaactggccgtgcttgaacggaaaattacgatggccaaagcttacatgctgaacccggaagactttcggcccggcggggtgtatcagatagaaggttctgatgacactttccgcattgattacatcaacggcgtattcgcctggggacacagatcttccccgtctgacggggaagaagcactgccgatttccgttttaaaagaaaaataataacaaaagaggccggttccggcctctttttcttttcgggcacattcgtttcaacctttcagtaaaaaatgattgaattcatttttgatatcttttaagatggaattcgttgttttttaataaaaaggaggcgatttgcgttgaatatcaaaatgaaacagccatctgtgaaattaatgatttttgttttaatgatttgcacattttccatcgggtatacggaatatgctgttatgggtattctgacgtcgattgccgatgactttcatatacatgtatcttcagcgggcatgcttgttacggcgtacgcggcaagcgtctgcctgacgggcccgatcgtaactattatcgcggttaagctgccgagaaagccggtgctgctagggttgatgggcatcttcgtgcttgccaacctgatgagcgtctttgcgccgaacttcgccgtgctggcgatttccagaattttatccgcatccattcacggagctttttttgcgatcgccatggtgtttgcaagtgaaatggtgccgcctgaaaaacgttccgccgccgcggcttccatgaacggcggattaaccgtggcgctgatgctcggcgttccgttcggctcttatttaggggatgcccttaactggcgggccgtctttttcattatttctgttttaggcctgatcgggctgatcggactgatgctggtcgtaccgaaccgaaaaccgaaagtgattccgatgctgatgaatgaatggagtgtctttaagcataaacaagtgattttttcctttgcgatcaccattctcggctactcaggcgtctttatcgcttacacgtttattgagccgattttaagagattcagcggggttcggcacagtcggcattacaggcgcattatttgcctacggtctcggcggagtggcggggaatttcttcgcggggaaagtgccgctcaaactgctgacgcgcacgatgatcggtgtgatgatcggcctgatcggcgtcttggcgatttttccttatatcgctgtttttcccgccgcagccgtttcagcgacatttttgttcggcgcatgtgcgttcggcacgccgccgcttttgcagaccaaggttatttcctcctctgaaaacggcacgacaatcgccgctgcggtgagcgtttccgcctttaacctggcaaacgcgctcggcgcctggatcggcggattgattctcgggggaacgggatcttactcatggctgtttgccggcggtgcgctgatgacggctctcggccttgtgctttccacgttcgctcatctgtctgagaagaaagatgtttatgaataccaagtgcataaaggataacaaaaagcttgcaggggatattccgcctgcaagcttttttcaatgtttcaacgtaatgctgatcaccgtatgtttatcgctctcagctaaggaaatattccgggtttccggtaccccgtctttttcaaaaacaacggcataggttcctttcgcgccgcttttccatgtcatctcaccgtggtgatcagtcttgcctattatctctccgcggtctatattcggctgatgatctgactccgccgctttcatcacggtaaccgtcacaccggccgccggtgaaccgtctgcattctcaacatggagcgtaacgggcagtgcttttttggcggcggaatcatccgctttgccgcatccgcataaaacggctgccgcgagaaagaagacaaaagctttattgatttgaccaatattgaatgttgtcgaatacactgtttgtcacccttgttcccagattgtaagacgacccgccgtttgtatgaatggcaatggcggtctggccggtgtcgctgtaattgcggtaaacgggcgatccgctctggcagccgaacgtatctgtcgtgtaagtgagtttatatgtctcggcagaacgtatcggcttgctgtccgaccacatggaaccggacactttgtcgcacggataccctgtcacggttgaggaaagcccggccggactggaactgttggtcgtccgatagccgtaccagccgacagtattcccgggcgacccgtttactttgattgcgccgtagtcatagtttgtgtcaccgttttctgtccaccctttgacactgtagaatgtcttgcctgaataagagtcgtacgggtacgatgacccgttgcggccgggagctgccgtaattttcgatgcccagccgtttttctgatcatacacgcaatgtcccgccgtaacgatcgtgtcagcattgacaaaaaaaccggtgcatccgtaggtgcttgtgctgccgctgtatgtaacggtcagctgtgctgtcgcgcgatatggaaatgatgttgtgggagaaattctgattcgttcgtctgtcccaataatactggaaggctttaatgacttgatgtcagctttgctgttttgtgcaagctgtcttttggtgaggcccgttccttcataagcgggggatgtctgtgttgtttgtacaggctgattctgatttgcgtcaaactcctcaccgctgtttgatacagatgtctgcgggctgcccgctgcttctgctgaaacagcaaataatgaaactgacagtaagaatgcggtaaggctcagcaatcgttttgaaactgtcttcattttataaaacccctccttttttgtctaccggcttgcggtttagcatttaacatattatggaatttatttagcgttatgaccgcaagaggatgtttttttccgcaaaaaaaagaccgggtcattcccggtctcttacggtgtgtgttatcgtctgcctgaagctctcatgcgctcttgcgggtgcgaattaattgaaccgtccgcccgtttagaagcgtagtcatcctttgcccgcggttcgccttcaaacttattattgttctgattaggaaatccttttgccttgttccggaccatttgttttccccctcggccaatatcaaaaggttgcgccttctggactgaagacgtaaagttagtatatgcctgtgacaagctgcgtaaaagcagcaggttttcccaaggaaaggagacagagacatgaatacatatatcgacaaactgacgaatttgctgcttgagaaaaatgacatgctcagctatttgcaagcgcggacttgggttgagcttttatggggagatttcgaagcgacttacgcaaaagccggccgcccgtaccaaggagagcaaatgacggaacgcgtcgtcaaggaatggatcgaatcatacggcagcaagctccatatgttccaaagcgttcgggaagacgtttctcattatttggatcaaagcaggggtctcctgcattaatatagcagtgcgcccgccggataccgtccggcggttttttctttttataaaagaaatgggaaaatcatgtttgacgaccggcggaatgtggaaatgtgtaataacttataaaatagcggggaggaaccacaatgaacatgaaaaaggggttaaccgcatttattccggccgcaggactttgcttatttttagccgcaggcaccgttttttttgatccggcagcgaatgccgcagcagttcatcagacaaaaatagacaccgcagcagatacatatatcgtgaaagcaggagaacttaacgtccgcaaagaacccaataaacaagggcggattatcggcacgcttcgttcagaggattccgtaaaggttaaacggcttcaaggagcagattgggctgaaattgactacaaaggtcacaaagcctatatttccacgcattttctgatgaagcagccggtgaaggcggtgaccgcgaaacaaaccgatttttatacgccgactttggaaaccggcaaaaaagggtctgttaaagcgggtgaaaccgtcaatgtgctcggctgggggttcagccatgacggaggatttgaccgtaaatgggcgtacgtcacatacgccgggaaagcaggttatgtaaaaacggccgacttaactcaaaagtaaagattcaggcgggcgaataagcctgctttttttctgaaacctttcgcctttcctttcgtaaaagatgaaaaggagagtgacggatatgataatggtaatcggcggccttctgatggctgcggccggcatttcagtcacgttttttccgccgaagtcgatcaacagcctgtacggatatcggacgaagcgctctatggcggatgagtcgcagtggaaagaaggcaatcgattcagtgcgctcctcatgattctgttcggccttatttcggcggcagctggatttgcgggcagcctgcttatccggctgactcagccgttcgccctgatcgttcaggccgtattgttgatcgcgatcagcgtactgatcatcgtcttaacagaaagaagattgaaacaaacggggaggagaatcgatgaatgacattacgtttcacatgatcgaaacaaacggagtgacgctgcacacggcttcagccggtccgaaagacggtcctttggcggtgctgctgcacgggtttccggaattctggtacggctggaagagtcagatcaaaccgctggcggatgccggataccatgttgtcgtgcctgatcagcgcggctataatctcagtggcaaaccggagggcattgaaaactataccattgatacgctcagagacgacattatcgggctgatcactcattttacagatgacaaagccgtcgtcatcggacatgattggggaggagccgtggcctggcatttggcatccacgcggccgcaaaacgttgaaaaattgatcacggtcaatatcccgcacccggcggttatgcggaaggtcacaccgttctacccgccgcagtggaagaaaagctcttatatcgctttctttcagcttccggaaaagccggaacggagattgtctgaagacgattaccgcgtattggatcacgcgatcggcttatctgaacgcccggcgcttttttcacgggaagatgtcgacagctacaaagaagcatggggcagaaaaggagcgctcacggcgatgctgaactggtaccgggcgatcagagccggcggtttaggccctgccgttccgcttaaaatgcccgttccgtaccggttaatatggggcgtcaacgaccgcgcgctgagcaaaaagctcgccaaggaaacaaaacggatgattccaaacggcgacttaatcttcatagatgatgcctcacattgggtcattcacgaaaaaccgcgcatcgtcagccatttgattcatgaataccttcagcaataaagtctgtcccgcgtacagactttttcttttttttctcatatctgccgaaaaacatgacaaaatataaatcatatgcagaaaaaaatttctttccctgtaacaaaaaaagggtttaaacgtcattaaaaaaaggaaaagccttactgaagttttgcggacaattcctttaaggccgtcctaaaaaaagaataatacaaagaaggtgccttcatgaaacaaaggttaatctcaattattattccgtcttacaatgaagggaacaacgtcaagctcatccatgaatctttaaaaaaagaatttcagacgattcattatgactatgaaattttctacatcaatgacggaagcgcggatgacacccttcagcagattaaagaactggccgccagaaaccatcgcgtcaaatacatatctttttcccgcaacttcgggaaagaagcggccattttggcaggatttgaacacgtgcagggcgaagcggtaatcgtgatggacgccgatctgcagcatccgacccatctgctgaaagacttcattcaaggctatgaagaagggtatgaccaagtcatcgcgcagcgcaaccgaaaaggggacagccccgtgcgttccgtgctttcttccctgtattataaatttatcaacaaagccgtcgaagtggacttgcgtgacggggtcggagatttccgcctgctgagccggcaggccgttgatgcccttttgaagctgagtgaagggaaccgtttctcgaaagggctgttctgctggatcgggtttgaccagaaaatcgtattttatgaaaatgtcgaaaggaagaacggcacgtccaaatggtcattcagcaatctgttcaactacggaatggacggtgtcgtctccttcaacaacaagcccctcagggtatgctttttcaccggtattctgatattgcttctgtcgatggtttatattgtaacgacctttgttcatattctgacacacggcgtgtccgtacccggatacttcaccattatttccgccgtgctgtttttagggggcatccagcttttgagtctcggcatcatcggagaatacatcggccggatttactatgaaacaaaaaaacgcccgcactatttaattaaagaagcgaatataacgtacggagaacaaaatgaaacgaattatacaaaaaagcgcaagtggaaccattaaacagccgccgctgtgcgcagggtctggggacgttgtatgaaaaaaaataaatggatcttgccggcagcctgtgtgctggctgcggcagccgctcatatttttttcttaaaagagtggtcggaaggccgctatatgacggggtctggagacgggatcgcccaaatggcggtcttcaaaaagctgctgtttgatcaatatatgaacggcaggctgttttacagctattcgttcggactgggcgggggagtgtacagtcagctcggctattatttctctacttcttttctattcctgtttatctccgccgctgtccgctttttgcagcttattcagctgacgggtgaggctgatgcgctgttttgggcgcaggcctccgtttttatcagcatcgccaagcagagtttcatcatattcacggcggcgtgtgtgttccgctatttcgtcaaacggacggtgcctgcttttgccggcgccgtgttgtacggggtctcgattatctacttccggcatgaggtgtattgggactttttcactgacagtatggtgtggctgccgctgctcgtgctcggcgcggaaaaaatcatcagggaaaaaaagccggcgtggtttatcttcgcctgtgcgctgacattgatcaacaacttttattttgcgtatattaatctgattttcatcggcatttatatcttattcaggtggatgatcccccttgaaggcaatgaggcgaaaaggctcgctcaatgcaggatatttattctgtcgggccttctcgggttcggcataagcgcagtttcctttatccctgtcgtatacggatatcttcataatctgcggccgccgtattcagagcaaattgcatggcttgatttttccgacaacattttattttcaagccggataatcattctgccggcggtttttttactttttctatttacattttctttatataaaaaccggctgttccggctgtttgcgggaatcagtctgctgtacattctgtttcacttcagtccgtttgcggcaagcgcctttaacggtttttcagctccgcaaaacaggtttgaatacgtcctgtgcttcacgattgccggaacggttgcagcagggctttctaagctttcagacatcagcatgaagagtatgctgatatccgccgtactcgccgttctgctctattggagccaagtgagacggttcagcctggatatttctgatcaggccaacctgcctatcctgctccttctggggctgaccattgccgctttccttgcagcaaagacaagactgaaaggcgcggtgtccgccgtctatgccgtcattctcttgacggcggtgctgacggctaatacatatgaaaaatatgcgttatcagaaggcgggaagatttatacggtatcgcatacctttatgacgggtcctgactataagggcaaagaacaaacagagcttattcagcgcctgaaagaaaaagaccctgatccgtttgcccgtttggattggatgaacggtgttttcaataacactccgatcatatacgggttcaacggattcagcgtatattcaagcatactgaaccgcaatctgctgtccttttactggaacgacctccggattgacatgggcagggaaagcgtcagccgttatgcgacattaggaaacagggctaatttatacagcctgctttacggaaaatattatatgacggaaaaaacaaacggggccggcgtgccgtacgggttcaaaaaaatcatggaatcatcccattatgcggtttatcaaaatcaatatatgcttccgttcgtacggacagctgatcgcgtatataacgaggacggtctgaaaaaagcgccctcccttgccagagaacgggcaatgcttgacgggatcatcacggaatcaagcgcagccaacacgaaaaaagcgcctgaggcgaaaaatatgatccgtcaggcaaaggtaacggccgaccatgcggattatcaagacggcatcctgacggtaaatgaagacggcggcggcctgatcattacgccgcaagccgctaagatggacggcggcgattattacgtcagcttttatttgaagaataaagcgaaggaccagggctttacattaaaagtgaacgattacacgacaacgagaaaatcgaatcaatccatttacaaaacaggtgtcaacgatcttactgtcagagtgccgaaaacaaaaaacatccaaatccgtctgccgaaaggatcgtatcagcttgacaggctggcgctttacgaagaacggtacgatacgctgaaaaacgcataccgaaaagcggaaaaagaaccgcgggccgatctcagatggcgcggaaatacgcttcatatctcgtatgaaaacaaaaccagcgcgccgtatatcatgcttccgattccatatgaaaaaggctgggagctgaagataaacggcagaaaagaacagattgaaaaagcggattattcctttatcggatttaaagcgcaaaaaggaaaaaacgatattcaattaacgtattacccgccgttttttaaacccgcggccgctctatcggtgatcagcctcgtgtttgccgcattatatgtgagaagacaaaaaaagcccggctcttaaacagagccgagctttaattttttctgcagtttttcctcgctgaaaatccagcccgtgtaggaagagagaagctctaaatcatgactgaggtggacgatggcgacaaaaggatagtggcctttgctccggtagcgcaaatcaataaagcgcacctcataatgatctttaaaagtatcgacctcccacctgtaaacgggggaaaatgaaagaaaggctgcaatattttcgtcctgtttcgcggccttcatcacatcggtttccggaacgggcacgcggttgaatgtatccaatatcacgacatggccgtcaaggcttctgccgacataaaaggcatgggccgtcgtcacggcgatacgccactgcctgaatttcatcgtcggcgaaataatgatggtttcaatctcctcttcaatcatttcgcgcagccttcgctttatccgcagctgcatcaaaaaccggacggcgtaatatcctgcaaggatgatataaagcatcagaaatgtcacgcccggatgacctccgatataccaaacggcaatcgcggccaaatggctgacgaaaataaacggatcaaaggtattgattaaaccgagagcgatccattttctcgaaaacgggcggatggcctgtgtgccgtacgcgttaaaaatgtcaacaaacacatgcaaaacgacagccagaagcgtccacagccacaggtgcaaaaagttcgcttccggataaaacataaacaaaatgcccggaatcagaacggaccaaaataatacggcgggaatggagtgcgtgaatcctctatgatttcgaatataaacggcattatttttcagcttcaatatggtatcaatatcaggtgcctgagagccggcaagcgcggcgatcataactgcctgagacattggggtgtgcatgccgacggcaggatcaagagttgcgattccgccaagcgcgatacccatgacaacgtgagtgccagtatccattgttgacctcctagcaggcgttaaaaatcagccgcccgcatatttcgcattataagatattccccattttctgtttgcccaatcatggcgtttatccgccgttctcatatgtttccgctttttctttatcactatttaatgtaacatattatcgtaacgtgcccttagtttacaccaaaatacagtgtcaagaaaagcggaacccgaaacatctgaggagaagatatgaacgcacttgaagaaaaaatgaaacaaaaagatatagacaaatttcgcgaggacttaattacatggttcgaaagagaacagagaattctgccgtggagagaaaatcaggacccgtatcgggtgtgggtgtcagaggtgatgctgcagcagacgcgcgtagataccgtcattccttatttccggcggtttgttgagcaatttccgaccgtttcggcgctcgctgaagccgatgaggaaaaagtgctcaaagcctgggaagggctaggttattactcccgtgtaagaaatctgcaaagtgccgtaaaagaagtacatgagcggtacgggggagtcgtccctgccggggaaaaggaatttggcggactgaaaggcgtcggcccttatacaaaaggcgccgtgctcagcatcgcatacaacaaaccgattcccgccgtagacggcaatgtgatgcgtgtcatgtcgagaattctttccatatgggacgatatcgcaaaacctaaaaccagaaccattttcgaacaggcggtatccgctttcatttctcatgaaaaaccatctgaattcaatcagggtttaatggagctcggcgcgatcatctgcaccccgaaatcaccgtcatgcctgctttgccccgtacaaaagcactgttcggcatttgcggaagggacagagcgggagctgcccgttaaaagcaaaaagaaaaagcccggaataaaaacaatggcagccgttgtgctgacagacgaacaaggcgatgtctatattcataaacggccgccaaaaggcttgctcgccaacttgtgggagtttccgaataccgaaacccagaaaggaatcaaaaccgaaagagagcagcttgaagcctatttagaaaaagagatgggaataaccgctgaaatcggggagctggaaggcatcgtagaacatgttttcacccatctcgtctggaatatttcggtctttttcggtaaagtaaaacaagtgtcggatacaacggaattcatacgggtcacaaaagaggagctcaaggaatacgcatttcccgtttcccatcaaaagatatggaaaatggcggaagaaagcggccgctaaaaagcgtcagtcatagctgacgcgagtgccgtggccgtaatccgcttcattccgtttcagtccgccgcgggcttcgatttcctgaatcagttcccggtatttggactggccttcttcgtttaaatacggcataatttgctggaaggcatgatggaaataggcgagctctgaatctctccaatcttgtttgggcatcatggccaattcgcccatatcacgtccgacatacatataaaagacccctttcaacagatattgcttttattgtttgttgaatgaaaagaactatacacagcaaggagctgaggaaaaatggaacaaaataaatgcgcactgatcacgggaagcagccgaggcgtcgggaaagcagccgccatcagactcgcggaaaaaggatacaatatcgtcatcaattacgcccgcagtaaaaaagcggcattagaaaccgccgaagaaattgaaaaactcggcgttaaaacgctcgttattaaagctaatgtcggccagccggcaaaaatcaaagacatgttccgccagattgacgaaacattcggcagactggacgtgttcgtcaataatgcggcttcaggcgtgctgagaccggttatggaactcgaagaaacacactgggactggacgatgaatatcaacgcgaaagcattgcttttctgcgcccaggaagcggcaaagatgatggagaaaaacggaggcggccacatcgtcagcatcagctcgctcggcagcatccgctatcttgaaaactatacgacggtcggtgtctcaaaagccgctttagaatcgttaacccgttatctggcggttgagctttctccgaaaaacatcatcgtaaacgcggtgtcaggcggagcgattgatacggacgcgctgaagcatttccctaacagagatgaactgctggaagatgcccgccaaaatacgccggccggcagaatggtcgagattaaagatatgatcgacacggtggagtttttagtttcttcaaaagcggacatgatccgcggccagaccatcattattgacggcggacgctctctgctcgtataagttttaaaaaaagatgaatagccttatcgtctcctgcgcattctaaagtgcgtggaggtgataacaatggcaaactcaaaatacagcaaaacagacgttcagcaggtgaaaagacaaaaccagcaatcagcttccggtcagggtcaatacggcactgaattcggcagtgaaactgatgcgcagcaggttagaaagcaaaaccaatctgctgaacaaaacaaacagcaaaacagctaatcactgaaacgaaaaagcacttcatcttcggatggaagtgcttttttctgttgctaaaacgacaaaacttgtgattcctctacagaatgagtcaaagggttttccggcgtaaaatcgaaatggtaaggagtatcaacctaaagcctaaggaggaacccgatgtcagagtttgaaaagcttgtaagtgaacagatgaaaatcatggatcagcttctcgagctgcagtcagaacttgaccgctgccggcaggtggaagcggaactcatcagtctggaaagagatgcaaagctggacaatgtacaggacgaaattgcgacaaagcgaaaagacctggccggcatacaggagttattccaaaggcagacagagcaagtcatccagtcttatcgcagcacggaaaagccgtcttcctatgtgcagaaatgaatgtgccattccggaagcggagtggttcttttattttcattttttaattcgtaacgttataatagtgaaaagacttgtcggaaagcaattgcggctgcattgactgcagggctttacagaaagtaggggagaaatatgggatatcccaaggaaggagaaaccattcaaattcacagctataagcataacgggctgcttcatcgaatttggaatgaaacgacgattttaaaaagtacggaattgtgtatcatcggagccaacgaccggacaatggtgacggaatccgacggacggacgtgggtgacgagagagccggcgatctgctactttcatgcccgtcagtggtttaacgtcatcggaatgctgagagatgacggggtacactattattgcaacatcagctcgccgttcgcttatgacggagaggccatcaaatatattgattacgatttggatgtcaaggtgtttccggatatgacgtataacattcttgacgaggatgaatacgatgaccaccgcaaatcaatgaattaccctaaagagatcgacagcattctgaaggagtatctgaatacgctgctgcattggattcatcagcggaaaggaccgtttgctccggaatttgttgatatgtggtatgaacggtatctgcgctatacaaaataaagaatacaataaaaaacctgttggggtgtcaacaggtttttcacatgggctcacacgccttaaagagagagggggataaagtgtgggcgtaatcagacgctatatgcaatttgtaaaaccttataaaaaacaaatttttatcacagtgttaatcggcattataaaattctccatcccgctggctctcccgcttctgttaaaatacgtggtcgatgacattattcaagggagcggaacggcaagcgctaaaacatcatcgctattcacgataatgggcatcatgttcgtgctgtttttaattctgcgtcccccggtagagtactatcggcaatacttcgcacaatggacgggcagccgggtgctctacgatatcaggggggtattgtttgatcatattcagaaattgagcctgaggttttatgccaacacgagaacgggcgaagtcatttcccgggtgataaatgatgtcgaacagacaaaagactttgtcataacgggactgatgaatatctggcttgatatgatgacggtgctgatcgtcatctgtattatgtttacactcgatgtgaagctgacattgatatctgtcattttgtttccgttatacggaatttcagtgaaatacttttacggccgtctccgaaaactgacacgtgagcgttctcaggcactcgcccaagttcagggacatttgcacgaaagagttcaggggatgcccgttatcagaagtttcgccattgaagattatgaacaagccaattttgatgaaaaaaacggacattttctggacaaagcgatccgtcatacgaattggaacgcgaaaacgttcgcagttgtgaataccattacggatttggcgccgctgcttgttatcgcgtttgcgggttattttgtcataaacggcccgctgacggtagggacgatggttgcgttcgtcggctatattgacagaatgtacaatccggtcagaagattgatcaactcatcgacgacgctgacccagtcgatcgcttcaatggatcgcatatttgaatttatcgacgagccgtatgaactgactgataaaccgaatgcattaaaagctgacggcattaagggtgaagttgaattccgaaatgtctcgttccgttatgaggaaggaaaagaaacgattttgcaggacgtttccttaaaggtgacaaaaggggaaaccgtcgcgctcgtcgggatgagcggcggcggaaaatcgacgcttgtcagcctcataccgcgtttttatgatgtatccggcggcagcctgctgattgacggcacagatattcgcgattatgaagcgagaagcctccgcaatcaagtcggaatggtgcttcaggatacgtttctgttcagtgagacgattcgtgaaaatatcgctatcggtaaaccgggagcgtctctggatgaggtggttgcggctgcgaaagcggcaaatgcccatgaatttattatgaacttccccgaaggctacgaaaccaaagtcggcgaacggggcgtcaaattgtcaggcgggcagaagcagcggatttcgatcgcccgtgtattcttaaaaaatccgccgctgctgatcttggatgaagcgacatcggctcttgatcttgaaagtgaacactacattcaggaagcgatggaaaagcttgcgaaaaaccggacgacttttatcgtcgcccacagactgtccacgattacgcacgcggataaaattgtcgtcatggaaaacggcgccgtcgtcgaaaccggcacgcacgaggaattaatggcccaaggcggccagtacagacacttatttacgattcagaatttgaactgatacaaaaacgtatgccgtccgaatgggcggcatacgttttttgaatgcaaaaaaacccggttttacggaagcaccgggttactcttcgtctgtttctaattcgctgtctttcgggtggtatgtctgaaaactcgtaattagcgtatcgagatgctccagctgctcgcggtattccgcaaccgcagccataatgctgagcatattgtaatcaagcagttcatcctcgcagttctgctgatttttcaagaaagacttcgtcaaaagctgtttatatcttatgctttcttcagcatcgtcatcatgcggtttgatcttgccgaccgtccgcatcagaatcctttcgtgccaatgaagcagataatcaatttcttctgtcagcgtctcctgaaattcctccggcatatgataaatctcgttttcatagcggtgcagctttttcagcgtatcaagcgcccgatttgccgtaataatcgcctgtctgaataaaacaagcttgcgcgactttacatacgtcgttttcttaaagtagcttctctcctctttataaagaaggtacgtatgatcaagcttcatcattttttccttcagcttctcaatatcctctttcaatatcgagtgttccgtagactgacgcatcgtcagcctgatccatttcatgatctcatcggtatattcaaccgtatgatgagtcagcttcgtttcgtatttcggcggaagaaacacaaggttcacaataaaagaagacagcacgcctaaaataacggtgcttgttcgtatcagagcgaacgtcaggaagctgtttcccggtgtttctaaaatcgcgataaccgtcacgagcgcaatcgaaatggtgtgttcaattttcagttttaacatgatcgtgatgacaatcactgcggtcaatccgatcataatcggactcggtccgaaaatcagtccgaataccgtagcgatgacagcgccgatgatatttgcctgaacctgatcaataatgataagaaaagacctgtaaatagagggctgtatggcaaatatagctgcaatcccggcaaagatcggcgacggaagtccgatccatgatgctaagtagagcgcgagcgtaatcgcaatccctgttttaaaaatgcgggcaccaagtttcattggtttgtgcgtgcattcctttctctaataaattatgtgccgaacgaacggctgacacttacatttccctgtcggctgatttgctaaacaataaagtaatatacagggatcataccaattattcaaggtctttttttgaaaaaaccattatctcacaaatcggacaaaaagaaaaagcggaagccccgggctcccgcttgtttcagaagttattttttcatatgtctgaacgcatcttcaacggcttgtaaagtggcgtcgatatcctcttcagtatgtgcggttgtgataaaccaagcttcatacttcgacggagcgagattgatgccgcgttcaagcatcagcttgaagaacttggcgaatgcttctccgtccgtattttccgcctgctcgtaattgacgattttttcatcagtgaagtaaaccgtgagcgcgccttttaaacggttgacggtgatggtaatgccatgtgtctccgcatgggcgagaatgccttgctcaagtctggcgccgagctcatcaagccgctcgtaaacgccttcttccttcagcacttccaggcaggcgatgcctgataggatagatgccgggtttccggccatcgtgccggcttgatatgccgggccgagcggagcaacctgctccatgatctcttttttgcctccgtaagcgccgatcggcaagccgcccccgataattttaccgagcgccgttaaatcaggcttcacttgaagaagatcctgcgcgcctccgtacataaaacggaacgccgtgatcacttcatcataaatgacgagcgcgcccgctttatgggtcaattcatttacctgttctaaaaatccttcttcaggttcaacgatgccgaagttgccgacgatcggctcgacgagaaccgctgcaatttctgaaccccatttatccagcgcggctttgtagctttcaatatcattgaaaggaacggtaatgacctcattggcgatgcttttcggcacgccggcggaatcaggggtgccgagcgtagacgggccggaacccgcagcgacaagtacgagatcagaatggccgtgatagcagccggcgaatttaatgatttttgtgcggcctgtataagcgcgtgcaacccggatcgttgtcatcaccgcttcagtgcctgagtttacgaatcgtactttatcaagtgaaggaatggcctccttcagcattttggcgaaagtgacctcatgtttggtcggcgtcccgtacagcacgccgttttccgccgctgttttaatcgcttcagtaatatgcggatgggcatgtccggtaataatcggaccgtaagccgctaaataatcgatatactgattcccgtctacatcccagaaataagcgccgttcgctttttccatcgcaacgggtgaaccgccgcctaccgctttataggatctggacgggctgttcacgcctccgacgatatgctctaacgcttccttatgaagttcaactgattttgtatacaaaaaatgaccctcctaatatctccttacatcatgttctattgtagcatgcttcattgcgagcacaacgggttcatgcttccagaaaagagccgggggataacggttgtaatcttaacgtgaattggatacgcttaataaaaaacccggaggtataagaaatgacgattgaaatcggacaaacagcaccggatatgaaattagtgaatgacagcggggaagaagtagcattgacggattttaaagggaagtacgtcgttctctatttttatccgaaagacatgacacccggatgcacgacggaagcatgtgatttccgtgatcagcacgaaagtttcgcgggacttgatgcggttatcatcggagtaagccctgacagccgtgataaacatgaaaaatttaagcaaaaacacgatcttcctttccagctcctcgttgatgatgagcacaaactggcggaagcttttgatgtgtggaagctgaagaagaattttgggaaagaatatatgggtatcgagcgatccacttttttgttagacaaagaaggccgtcttgtgaaggagtggagaaaggtaaaagtgaaagatcacgttgccgaggcgcttcgtgaattggaacaaattgcgtctaattaatggacaaatgctgaactcacggggttttcttcagattacatttgacaggagaccggaaaaagatgtacactaattataaacattataaagtaagaatcttttttagaagagaggtgcatgacggatggctgcacatgaattaaaagaagccttagacacgttgaaggatacgggagtccggattactcctcaacgtcatgccattctggaatatctcgtggattctatggcacatccgacagcggacgatatatataaagccttggaagggaaattccctaatatgagtgttgcgacagtgtataacaatttgcgtgtattccgggaagcggggcttgtaaaggaactgacgtacggagatgcgtccagcagatttgactttgtcacctctgaccattatcacgccatttgtgaaagctgcggaaaaatcgtggacttccattatcccgggcttgacgaagtggaacagcttgctgctcacgtcacagggtttaaggtaagccaccaccgtttggagatttacggcgtctgccaagaatgttccaaaaaagaaaaccactaaacgaagctgaccgctttgatacggtcagcttcgtttattttacactgttttttctgttataagactcatcgaacgctttgccttccaatcctttatccaatgtaagcggctctctgcaatgcatgcacatatccactctgcccagaatcttcgtttctttctcgcaagcggggcacatcacccggaccgcttttgtggacagcatgccgatccaaaaataaacggcggtgctgagtccgatcgacagcaggccgagaatcataaacaagctggcaagcaaaacagactgcttaaagaacagcccgatgtacataatgataaacccaacgaaaaccaaacttaacgcaaacgttctgatcttattaattttgcttgagtatttcgccatgtccatccccctctcgtttaactatagcacaaaacatatggcatattcttcatgttttcgtaagaaaagggaagaataaatatggcacctgaaaggaaatttgttataatagtgcaatgtgtttagaaaaaaggactttcatgttttatcatagaaatgtagaaacaatagctagtgaaacaatcgcattggaggaatcgtaatggacaatcttctccgtccaatttaccaagaaagagcaagtcatcccgatacgctggccgtccttatgattgagagaaggagtaaagcatcatccatcacggataactttgatgcggtcatgcttgtcattgtgaaacaggctgatgaacctctttttataaagcattatgaattcgaacacaaaaccgcttctttacatattgtaacggatgctctgcttcaggaatggattctgcttgggacaaatagaagagtcatagattggatcatcaacggcaaagtgctgtttgaccgcaatgaatatatatctgaactcaatgaccggctcagcacttttcctttcgccgagcggaaattaaagatcggaatggaatacggcaagctgatcagaagatttgtagaaggaaaagcgttttttgaagctgatcattttctggatgcatattatgcggtagtgcacgctcttcaccacttggcccgcatagaagtgattgaccgggggttttatcccgaaacgacagtctggaaccaggtccgtcacattgagccgcaggtatataagctatattccgaacttgtcgagagtcacgaaagcttggagaaaaggctcgaattattattcttagcaaatgattttctcatccattcaaaagctgaaatcggttctgcgcacctttttcaggtgatgaaagaaaaagaaatgtggcagtttggagaattgcttcagcaccctgaactggtgcacttcacccaagatctcggtgtcatgcttgattacctgacggaaaaaggctttgttgaagtatctcaaatagagaccaaagggcaggaagtatatcatcgaggatattctttcaaaaaaagtgttgacgctgaatcataggcatggtatattattaaacgtcgctgatgcgcttcaccaaaaagctcacagcggcggagaaataaaaacaaaaaaacatttgacagcaaatcgctgaaatgttatactgaaaaagtcgcctcgagatgaggttgagatgatctttgaaaactaaacaagacaaaacgtacctgttaattcaaagttttaaataaatcgcacagcgatgtgcgtagtcagtcaaactactttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggattttaacggaatataagacctcgggtcttataaacagaacgttccctgtcttgtttagttttgaaggatcattccttcaaaacataggaacacctgctaaatgcgccacttcctgtggcaacgcatgtgttagcatgtcctatgcgttgttctttgaaaactagataacagaagtaattcacattcaattagtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccaccactcgtaatggagtggtatccatatctgaatacataggatatgagaaggcagacccggggaactgaaacatctaagtacccggaggaagagaaagcaaatgcgattccctgagtagcggcgagcgaaacgggaccagcccaaaccaagaggcttgcctcttggggttgtaggacactctgtacggagttacaaaggaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagcagaagatgcggagccgcagcgaaagcgagtctgaatagggcgaattgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtctcggaggtagagcactgattggactaggggcccctaccgggttaccgaattcagtcaaactccgaatgccgatgacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttcgaacagtggtaggagagcgttctaagggctgtgaagcaagaccggaaggacttgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggataacaggttgatattcctgtaccacctcctcaccatttgagcaatggggggacgcaggaggatagggtaagcgcggtattggatatccgcgtccaagcagttaggctgggaaataggcaaatccgtttcccgtgaaggctgagctgtgatggcgagcgaattatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgccgcccttatcgggcggggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattccgcaaggaagtaagatccctgaaagatgatcaggttgataggtctgaggtggaagtgtggcgacacatggagctgacagatactaatcgatcgaggacttaaccaatttgaatgtatgcttactgttatctagttttgagagaattttttaaaaaaactcttgctttttccgaaatacatagtataataatacatgtcactaaaacgtctggtgatgatggcgaagaggtcacacccgttcccatgccgaacacggaagttaagctcttcagcgccgatggtagtcggggtttccccctgtgagagtaggacatcgccaggcagacttcattccgcagtagctcagtggtagagctatcggctgttaaccgatcggtcgtaggttcgaatcctacctgcggagccaattatggagagctgtccgagtggccgaaggagcacgattggaaatcgtgtaggcggtaaccccgtctcaagggttcgaatcccttgctctccgccactaattatcaatacataacaaacgaaaaaataccagggcccgttggtcaagcggttaagacaccgccctttcacggcggtaacacgggttcgaatcccgtacgggtcacttatatgatggaggattagctcagctgggagagcatctgccttacaagcagagggtcggcggttcgagcccgtcatcctccaccattatcatcgcggggtggagcagttcggtagctcgtcgggctcataacccgaaggtcgcaggttcaaatcctgcccccgcaaccaaaaaaatggtccggtagttcagttggttagaatgcctgcctgtcacgcaggaggtcgcgggttcgagtcccgtccggaccgccatttataaaaaggctcggtagctcagttggtagagcaacggactgaaaatccgtgtgtcggcggttcgattccgtcccgagccaccatttgccggtctagctcaattggtagagcaactgacttgtaatcagtaggttgggggttcaagtcctctggccggcactctaaatgatggaggggtagcgaagtggctaaacgcggcggactgtaaatccgctccctcagggttcggcagttcgaatctgcccccctccaccattttataaataggggcatagtttaacggtagaacagaggtctccaaaacctccggtgtgggttcgattcctactgcccctgccactatattatttattcatcttcagattatggcggttgtggcgaagtggttaacgcaccagattgtggctctggcactcgtgggttcgattcccatcaatcgccccatattatcattgggctatagccaagcggtaaggcaacggactttgactccgtcatgcgttggttcgaatccagctagcccagttgcatttttttgaaaacaacagcataagatgtattaagttcttttacatgttgcggaagtagttcagtggtagaacatcaccttgccaaggtgggggtcgcgggttcgaatcccgtcttccgctccaaattacggcggcatagccaagtggtaaggcagaggtctgcaaaacctttatccccggttcgaatccgggtgtcgcctttctattgccggggtggtggaattggcagacacacaggacttaaaatcctgcggtaggtgactaccgtgccggttcaagtccggccctcggcaccaatttaactttgagcgaattatgttaaattggtcatcaattttcttattataaaacatatatgagagtgatttgcatattgcaggtcgctttttttatataataaaagcgtgaagactatcaatataagtttcttgcttgtatcgtatatactgcattaccatttgaaaaaactttactaaaaccattgactctttatagaatgcatgttatatttatatacgtcggttgaacacgacgcattatatgccggtgtggcggaattggcagacgcgcacgactcaaaatcgtgttccttctggagtgccggttcgaccccggccaccggtatacaaaggcttctacatattgtagaagccttttttgttgtatgaaaatatctccaaggcttgtgaaaacatgatacctgcagtaggaggagctggattcggcgcaccgtgcttatattaaggaaacaccgattcggccgtggagttaaatctttccgatcgggctgtttttgctattaacactgtttctcagctggtggggcggccattcaaaagcgcgcattattggcagcggttattgcagtatttgctctttttatgtttcagcgctttcctgcaggcgagcttgttacccattttattaagggcggaaacgaattggtcaacgttattattatgttatcgctgatttgggccgtaacagcagtagctgaaaatctgggattctcgaaatatgttacttctcatttaacatcatggagccctcatatgtttattgcgccgtctctttttatactgggggctgttatatcccattttatcgggtcatcctgggggacttggggcgctcggcgtaacgctggcggttcagttacataccagcttattattagcgagcggaacatttggtttgcttctcccctcagtgataatacggtgttggggatcaatgttgcgaagtatgcccgttcgaagcttgttccggcgattaacgccgcggggatctccgttgtgttatacggtgcgtatttttcagataacaaatactttttgaaggcgttatccgaaattgagataacgcctttttaatgagctgttatacttgagaaaaaaagaagtgatgacattgaagcagattattgcaatgggcggcgggggttttccatggagccggatcatcttgtgctggatcagtatattttagagcagtcggcgcggtcaaagccgaaagtttgttttttgccgacggcaagcggagattcggagaaatataccggcaggttttatcaggcctttcaaaagctgcggtgtgagccggatcacttgtcgctgtttaaaccgccgggttctgatctcagatcctttctcatgaagaaagatattatatatgtcggcggcggaaatacgcgcaatatgcttgtcttatggaaagagtgggggcttgaccttattcttcgtgaggcttgggaaaacggcatcatcttagcgggtctcagcgccggagcgatttgctggtatgaagaaggggtgacggattcagcgggggatttgcgagagttaacagctttaggatttttgccgggcagcttttgtccgcactatgacggagaagcggagcgccggccggtgtatcaccgtctgatttccgaaaagatactcagggagggctatgccgctgatgacggcgctgcgcttcattataaagacggtcagctgttccgggctgtctcttcccgggaaaccgcaaagggttatcgggtttttaataccgaagaaggcgttcgggaaacagagcttatgaccattccgttatctgaattttgataatatgcttttttttgtacacaacttatgttacgatgagagcgaaatcaatagttactgggggtgcccgtctgagcgggctgagagagaagcggcggcttcttaaccctttggacctgatctggttcgtaccagcgtggggaagtaaaggttttattattgttgaggaaaacaataatagtttctttctgactgcaaaaccgggttcttctttgaacccggtttttttgtgctggtgctgagcttggttctgttattcaaatgataaaggagagatttgtatgcaaaatcaatcagtacagcaagcgaacatttccattatgtcgagtttttccggcagtaaaaaggtttatgcagaaggttcttcgcccgacatacgagtgccgatgcgggaaatcagcctgagtgcgactacgggggcattcggggaagaggagaatgcgccggtccgtgtttatgatacgagcggaccgtatacagacccggatgtacagattgatattcatgaaggtctgggggcgctccgcacaaagtggattaccgggcgcggagaagtagaagaatataacggccggaccgtgagacctgaagacaacggctataaaaaagaagatcatgctgccgaataccccggcctgcagcggaaaccgcttcgggccaagccggggaaaaatgtaacacaattgcattatgcgagaaaaggcatcattacgccggaaatggagtttatcgcaattcgcgagcatgtgtctcccgaatttgtcagagacgaggtagccagcggccgggcgattattccttctaacgtcaaccacccggaaagcgagccgatgattatcggccggaattttcatgtgaaaattaatgccaatatcggcaactcggctgttacatcttctatcgaagaagaagtcgaaaaaatgacgtgggcgattcgctggggcgctgatacgatgatggatttatccacgggaaaagacattcatacgacgcgtgaatggattatccgcaactgccccgtgcctgtggggacggtgccgatttatcaggcgcttgaaaaagttaatggcattgccgaggatttaacgtgggacatttatcgtgacacattgattgagcaggcggagcagggcgtggattatttcaccattcatgccggcgtactgcttcgttatgtcccgttaacggctaaacgcacgacgggaatcgtatcccgcggcggggcgattatggcgcaatggtgcctggctcatcatcaggaaagctttctgtacacgcattttgaagaaatttgtgaaatcatgaagagctatgatatcgctttttcacttggtgacgggcttcgtccgggttcgattgcggatgccaatgatgaagcgcagtttgcggaattggagactctcggagaattgacggagattgcgtggaagcacgatgtgcaagtgatgatcgaaggaccgggtcatgtgccgatgcataaaattaaggaaaacatggacaagcagctggaaatttgtaaagaggcgcctttttacacgctcggcccattaacgacggatatcgctccgggctatgaccacattacttcagcaatcggcgcggcgatgatcggctggtacgggacggcgatgctttgctatgtcacgccgaaggagcatttggggctgccgaatcgtgatgatgtaagagaaggcgtcattacgtacaaaatcgcggcacatgccgcagaccttgctaaagggcatccgggtgcacagatccgtgacgatgctctgtctaaggcgcggtttgaattccggtggcgtgatcaatttcatttgtcgcttgatcctgaaagagcaatggaatatcatgatgaaacgctgccggctgaaggcgcaaaaacggctcacttctgttcgatgtgcggcccgaagttctgcagcatgagaatttctcaggatattcgtgattatgcgaaggaaaacggacttactgaagacgaggccgtcaatgaagggctgaaagaaaaagcaaaagagtttgcagagaagggaagccgcttatatcaataaaagaaaagatgaagatggagtgtatccatcttcatcttttttagaaaaacggtgaacggcgaagcggcggaatgctctgctcgaagcggaatatattttccggatcatatttcgttttgacttgacggaggcggtgaacattttctccgtaatacgtttgcagccagtttctgatttctctatcaggccaattcacataatctcccatcgtttctcttgatagggacgttctcagtccttcgatccagcggacattttgtctttcttcttcagcagatgtccaagttgtaatatattcttgggcaatgattgcgttgcgatagtagaatgccgtttggtccggagcgatccgtccggccgccccgccgagagattgctgccagacactggcgttttcgttcggagcgtgctctaaatagcgctttaaagtggatattgcgcgtgttgataatggtttttcaataaaggatcctgaccgcttcatcttttgcggctgattgcctcccgggctgttaaaaaaggctgctgctttaataaatggcactgtcttgaccatgccgcttgtcggttttcccgctttcattaacggagccagcagttctttcagctcctcttttgtcccggtaaattgaccgagtgcttctatgcggttgacttccttaggccaaaactgaattgatgaggtaagccggttgtctgtaaatggagcccagcgctgccacgtattaaatacttcctcgaaatcatcccagccccaagtgacagaaaaaacagacacgcacgagatcggcacggctttaaacatcatggatgtgacaatgccgaagttgcctccccctccgccctgagatgcccaaaatagatcagagtgctttgagcggttgactgtgatcaagtcagcacccgctttttcgtccgctatgatcatttcgagctggaggagacgatcgcaagtaagtccggcagtccttgttaaatatccgattcctcccccgagcgtcagccccgtgattcccacattcgcaatggttcccgcaggaagggtcaagccgtaccgccagagtgtccggtagacttcccctaattcggctcccgcttcaatcgagaccagccgcttatcctcatttactcttattttcttcatttcactgagatcaatgactagtccgtcatttaacagggaaaaattttcgtagctgtgtcttccgcctctgatacggaaaggcacattgttctcacgtgcccatctcaccgcattgagggcgtcatgtttgttttggcaaaacacaatgatgtctggatatctttgcaggcttaaattgaaattggttcttgcggcattatagtccgggtcatcttttttgacgatgcgaccgctcaatgttgtcttttccacattctcactcactttcacttgtaatctgctatgttttctagcatatgcggaaaaatgagagagtgtatgaggaaaacccccggaaggacacgatattttaaattgtagttgacaggtagggattgtatgaattaacataatcattacatatttccaaacgatggctgatcggatcaccgaaggctcttatctattaaacagataagggccttttttgcgtgaaagtcattaaatgaaaagcggagggatgaaaagtggcgttaaaaaaggtatcacatgtgcgcaaaaagagaaaaaagcggaaaaagtacagaaaacacacattgaatttcgaactgcttgtagagaaaaacaaacgggagattatgagaaatgaggaacagatggagcagatttatataaagatagatgaaaagcatgcgggggttcgataaagatgaaggagagaaaatggaggttgaaaacaacggtactcgcgctgtcggtatccatcatgttatcagggtgcgcgttagggagtgccggggaagaaccgtcatctgcggctgataaaaaggaagaaacacgtatcacccatgtcaagacaaaggaatttaaagcttctcatccggcggcgattcccgctaaatcgaaagccagaactgacacttttgttgctgggatttccgcgccgggcggcgtgtttctgccgtacttttacgaaaacggctgggatggaaatgcgacagatcctatttttgaaccgttagtcaaactggataaaacggggaagcctgccccggctcttgcggaaagctggaaaatttccaaagatcagcttacatacacgttccgtttaagaaaaaatctcgttttcagcgacggttcaccgctgaccgcaaaggatgccgcattcactttaacactgctgcatgatcctgcatacgcgggctatgaagatatcaccacggcttatattaaaggcggtaaggcttacaaagaaggaaaggcaaagacgatagagggcattcgcgtccttgatgacagaaccattcaaatcacgactgagaaagtcagtgcgaagtcgctgcttcttttgggcgggcaggtgctgtcagaagcctactacgggaagaaatatcaattcggcaaactggactatttaaaagagctttatgccaaaccgctcggagcgggaccttatcaatttacagaataccttccgggacaggaaatacgctatcaggctaatgaacactattatgccggaaaaccgaaaacggaaaagctgatttataaaattatcgatccgtcaacttcccttcagctgtttgaaacgggtgaccttgattacgcttctttctcacctgatgatgatacggttcagcatttaaaaagtctcggttttgcgaatataagcgtatctgtcgtgaatgattacgggcttgtgtacgtcaatcacaagcgtccgccttttcaagataagaaagtgtcccaggcgcttatttacggacttgaccgtcaaaaaatcgtcgatgtccgctttaaacgctacggagaggtcgcgaatgttccggtgtctccggtttcgtgggcttatgatgacaaaggtgtcaatcggtatgcgtttaaccctgaaaaagccaaaaagcttcttgacgaagcaggctggaaaacgggcaaagacggtgtacgtgaaaaaaacggcaaaaagcttgaaatcagctattacacatctaaagcggatgatgatttcatcccgatagcgaaagaaaattatgcggacatcggaatctcattaaaaccggaagtgatggattttaatacagaagtagcgaaaatcaatgacaaacaatatgaccttgccgccgtttccacctcgcagatccttgatccgaatgacacggtggaaaagctggcttccggccatcccaataatgtgacggggtattccaatccgaaagcggaccggctgatagagaaaggagccggcacgcttgatatcagcaaaagaaaagagatttatcaccagctgtaccgggagctcggggaaaacccgccttacattctgattcattaccgtcagagcgcaagggcggtcagcggaaaaataaaagggcttgaggctgacaattattctggaatcagttcaagtctctcaaatgtctcaattcaatagaacggttgggcaaaatacccgatgcatcctggggattttgccctttcagcggaaaggaggggctttttatgaaacggtatgccgcagaacgattcattcaaatgcttgtgatcttattcggtacgtcctttattatttttttcttattcgccatgctgccgggcgactatattgattccaatgtaaacctgactccggaaagagcgaaggagttaaaagcgctttacgggctggatcagccgatttggcagcgttatgtgacatggctcggaaatgtgctcagcggagattttgggttttctttgaaatatcaggagaacgtcctgtcactgcttcggaaatatgtctggaattcgttttttgtcgcgtttttggcgttgcttgttacatggtcagccgcgatgataacgggtgtcatatccgctgtcaggaaatactcatggtttgacgggatcgtgacgtttcttgtttttgcttccatggcgtttccgtctttttttatcagccttctgtttattaagtggtttggggtggatttgaaaatattgcccgtcggcgggatgattgataccggcagcacgagtacaggtttttcgtacgtgcttgaagccgccagacatatgattcttccggtcgtgattttatctatgctcggcatcggctcgctgacaaggtatttccgctccggcatgctggacgtgatcagacaggattatatcagaacggcgagagcgaagggattgaaagagcgcaccgtcatctggaaacatgcgttgaaaaacgcgcttattccggccatcaccctgcttgcttttgaactgccgggactgttttccggagccatcattattgaacagattttcgggtggccgggtgtcggacgtattcagcttgaatctgtgcattatcgtgattatccggttttgatggcgtttaccttgtttttgtcttgtttaacgattgtagggaacttcttggcggatatcgcttatgccgcggttgatccgcgggtcagactgaaatagggggtgttcggaatgaaaaaacaaaaagaggtgccgccttctctttggaagcagacgtaccgccgcctgctgcagcataagctgacggtcatcagtcttcttttcttatattttatgtttttattgtgctttatcgggccgtctttttctccgtacataacagatcggacggatatttcaaatgccaatcagcatccgggaatccatcactggctgggcaccgaccagtacgggagagatgtgctgacgaggctgatgctggcggggcagatttctctgaccgtggggcttgcttcaatggtgctgtcgcttgtcatcggctctttactcggggctgcggccgggttttatcggggagccgctgatatgatcattatgcgcattgctgatatgctcatgtccatcccgggcctgccgctgcttttgattttggctgcggtgatgtcggagtggaaagtgccttctgaatacagaatgtacctgattatgatgatgttaagcctgatcggatggcccggtttggcgcggcttgtacgcggacagattttgtcgctgaaggagcagctgtttatgatggccgcggaagttttggggcttagtgataaacggaaaatcctctatcatttgcttcccaacacattgccgttattactggtagcggcgactttgcatgtggcgggagcgatgctgagtgaatctgcgctgagttttctcgggcttggcgttgctccgccgacaccttcttggggaaacatgatggaagcggcgaatcattttatggattttacactccgcccgtggctgtggattccgccgggaacggccatttttctgaccgttgtggcgattcatttgcttggagacggtttaagagacgcttttgatcctaaggtaaaacggcaggtgaaaatgaaatgaaaaaaccgcttttagaagtaaggcatttggaaacggctttttatacagaggagggtgcggtaaaggccgtggacggagtcagctttacgatacatgaggaggaaacggtttgtattgtaggagagtccggctgcgggaaaagtatggcgtcattgtccattatgcagcttattcccgagacggggagaatcgaacggggagcggtgcatttttccggacagaacctgttggaactgaaaccaaaagacatgcagaaaatccgcggaagcgaaatcgggatgatttttcaggaaccgatgacatctttgaatccggtgtttacaatcggtgagcagctgaccgaaccgattcgcgaacatttgttgctgagtaagaaagaggcatggcggagagccgttgaactgatcacgttagtggagatcccgaatgccgagcaggttatgcaccgatatcctcatgagctgagcggcggcatgctgcaacgcatcatgacggctgtcgcgctaagctgcgatccgaaactgatcattgccgacgagccgacgacagcgcttgacgtaaccattcaggcgcaaatattggatttattgcgggatatgaaaaagcaatttcgcacgtctattttattcattactcatgaccttggcgtggttgctgaaatggctgattatgtgattgtcatgtatgcgggaaaaattgtggaggaaggaccggttgcagagctgttttctgatccgaagcatccgtatacgaaagggctgctcgcggccaagccggttatcggtcaaaaaagggagacgctttacaccattccggggcaggtccccgagcttgcggacctgtcgggatcgtcttgttattttgcggagcgatgtgaacacagcacggaaatatgccggagatcgagcccgcattttactgaattcgggaaggggcatcaggcggcgtgctggctttacagagaggagaaagcagatgagtgatgtgttgctggaggtcaaggggctgaaaaaatattacgaggagcatggggggatgagaaagactcataaaaaacccgtaaaagcggttgacggtgtcagttttacgataggaaagggagaagtgttcggcttagcgggagaatcgggcagcggaaagtcatcaatcggcaagaccattttgaggcttcatgagaaaacagggggagaggtgttttttcaggggcgtgatgtgtttcggatgagccggcgcgagctcaaaactttcagatcggaagcgcagctcatctttcaagatccgttcagttctttaaatccccggcgccggatcggagaagccatcggtgaagcgatgatcgagcatcaattggcggtgaagcggaatgcgcgtgataaagcggcggaggttcttgaagcctgcggactttccgcaaacttcatcgatcgttatccgcatgaattttcaggagggcagcggcagcggatcgtgattgcaagagcgatggcgctcaaaccgcaatttatcattatggatgaacccgtggcggcgttagatgtctccatccaggcgcagatgatcaatttgttcagcagccttcaaaaacagcacgggctgtcatacttgttcatttctcatgatttaagcgtggtggagcacttatgtacgaaggtcgccattatgtatttagggacgattgtggaatatgcgtcaaaggaggagctcttttcacggccgcttcacccttatacgaaagcgctgttatcagccgtgcctgttcctgatcccggagcgaaaagggagcggataattttaaagggtgatataccaagcccctctgatccgccttcaggctgtaaattccgaacgagatgtccggcagccaagaagatatgtgctgagaaaagtccggcgctgtcagaaaaagggtttcatcattttgcggcatgccacttcgtgtaattgagaaaaaaacggttttattgataatgaacataaaaaacctgccgggcagaccggcaggttttttgatgttattttggtgacggcagtccgagtccttcggcaacgcgtctgccgtattcaggatcagccttgtagaagtggccgatctggcgcagcttaatttcttctttttccacaggtttcatcgcactgacgatattggcgacaaggcgcgcgcgctcttcctcgctcatcaggcggtacaggtcgccggcttgtgtgtaatgatcatgatgattatagcttacactgtcagcgaaacctgatacagggtatgccgcctgtttatcttcaggtgactctttcgggccgccgaagctgttaggctcgtaatagacggagcggccgccgttatcatcaaaacgcatttgtccgtcacgctgatagtttttcacttcattgcgggaacggttgatcggcagcgcctgatggttcgcgccgacacggtagcgatgcgcgtcatggtatgcgaacaaccggccttgaagcattttgtcaggtgagacgtcgacgccgggcactaatgtgccgggagagaacgtcgcctgttctacttccgcaaagtaattttccggattgcggttcagaaccatgcggccgacttcgatcagcggatagtctttttgagaccatacttttgtgacgtcaaacggatcaaagcgatatgtgtttgcatcttctaacggcatgatttgaacatataatttccatgcggggaaatcgccgttttcaatcgcattgaacaaatcttccgtatggtaatcgggattttcgcccgcgatttttgcggctgtattaacatcaaggtttttcacgccttgctctgttttaaagtgatatttaatccagacgccttcgcctttatcatttgtccatttaaatgtatggcttccgaatccgtgcatatggcgaagagtcgccggaatgccccggtctgacatcagaatggttacctggtgcagggattcgggtgacaaagaccagaaatcccaaacggccgtcggatttttcagatgtgttctcggatctcttttttgtgtatggataaagtcagggaacttgatggcatcgcggatgaagaacacgggtgtattgtttccgacgatatcgtagtttccttcttctgtataaaatttaacggcaaatccgcgcgggtcgcgcactgtgtcactagagcccagttcgcccgcaacggttgagaaacggatgaaaagcggcgtgcgtttaccgacttctgacagaaatgcggctttcgtatattttgtaacgtcatttgtgacttcaaaataaccgtgtgcgcccgcgccttttgcgtgaacgacacgctccggaacgcgttctctgttaaagtgcgccaatttctcaagcagatggacgtcttgtattaaagcaggaccgcgatcgccggccgtcattgagttttggttatctccgacaggagcgccccagctggttgtcagtttatttgaactcatgtgatcacctctttaaatttataagaacataatatcacctatcagtaaaaagtcaatattattttataatgattataaaataattatttttattatcgaaaagaaggtatgggtttaataacacacttgactgacgggaataatgggtttaatatgagaaaaaatagaaaccgctgacttggacacaagaggctcttattcttcactggataagggcctttttttattgtcaggcggtaagggaggcggcgattgtatgcttttccggcagcattttaaacctgtcgatattcacggtcatctgccgtacagccttaatttcggcaaaaacgataagacattttccgattataaccgggagcggtcggaaagaatgaatctcacttgggattttcctgatccgcatgatgttgatggcgatgacggcgaaatcgctttgatgacaagatgggagaaagaattagataagtacggcattgacgtgctgaattttttaacagcagagagcaatgaccggatggcggcgtttattcaagccaatcccgcgaggtttaccggatttgcatatcatcctttggaacaaaaggatgcgtatgaggagctgaaaagagcggttgaagagctcggtctgaaaggatataaactgttcgggccgctgacagacatcgagtttcatgatccgtcgctgaaaaagctgtggacgtatctggctgacaaaagactgcctgtattaattcacttcggacttttagggagagcggggggcattgtcagccatcgcaacatcaacccgctctccatctatcgcgtcgcgagagagtatgctgatataccgttcatcattccgcatttcggcgccggatattatcaggaactgctgcagctgtgctggagctgcccgaatgtgtatattgacacgtccggctcaaatcagtggatgaggtggatgccgtaccggcttgatttggaaattctgtttcgaaagacatctgaattaatcggtgctgaacggatcatcttcgggacggattcgaacggatttccgagaggatatgtatacagatatcttcaggagcaggtgaggacctgccgggaaatcaatatgcgggaagaagatatagaaaacattttcggcaacaacgcgcagacattattgaaaatcgcccggaaagaaaaggaagtaaatacgtgatacagccgatgcgctctttggcaggtttatgccggaaggcgcatttttaattcatacaaaaaacagttgacaagtcggaataatttgaattaacatgatattcaaatttaaaaacaaacgggttgccgatcggaccgccgaaggctcccatctctgcaagcaatcggagatgggggcctttttgtttttcgatcgcatgcggcagaaagagaggggaagacagatggctgtaaccatcagcatacaagaaaaagcttttgagcatgaaggccggaaaacgccggtgctgaatgatattgagctgtcaattgcatcgggagaatttttgactgtcatcggaccgagcggatgcggcaaaagcacgcttttaaaattgattgccggtcttgataccgattataaaggctctgtcgcaataaacggccgcaatgtgtcgggaccgggcatccggcagggatttatctttcaggagcaccggctgtttccctggctgacggtaaaacaaaacatcgctgccgatctcaatatgaacgacccggccgttcggaaaaaagtggatgatctgattgaggttgtcaggctgcagggagcggagaacgcttatccgcgcgaattatccggcggcatgtcgcagcgggttgccatcgccagagcccttttgcgtgagccggaggtgctgcttttagatgaaccgttcggggcgcttgacgcttttacgagaaaacatttgcaggatgtgctgcttgatatatggcgcgagaaaaaaacgacgatgattcttgtcacgcatgatattgatgaatccgtctatttaggcgataagctggcgatcctcagggcaaagcccggccggctgcacagcctgatgccgattcagcttccgcatccgcgcaatcggacgtcagcggattttcaggccgtccggcagaaggtgctttctgaatttgagaaaacggaagacctccggtttgcggatgggtccggaatatagaagggacgaagcgaagtgaaaaaaatcatcattcttttagccgcagcagtcatgatgtcagccggatgcagtgcagacgggacaggagggggcgggaaaacggtgaaagaaatccggatcggcatccagcagagtttaagcccgcttctcattgccaaggaaaaaggctggtttgaagaggccttcaaaaaagacggaataaaagtaaaatgggtcgaattccaaagcggtcctccgcaatttgaaggtcttgccgccgataagcttgatttttcccaggtcggcaattcaccggtcatttccggtcaggcggcgggaattgattttaaagagatcgggctgtctcaggacgggttaaaggcaaacggcattctcgtaaacaagggcagcgggattcagagcctgaaagaattgaaaggtaaaaaaatcgccgtagccaaaggcagcagcggctttgattttctctataaagctttagataaagcggggctttccgccgatgacgtcaccatcatccagcttcagcccgatgaggcggtttccgcttttgaaaacaaatcagttgacgcatggtccatttgggagccgtatttgtcgattgaaacgctgcagcacggggcggaaatattggcgaacggagaaagcacagatttatattctcccggtttcacattagtcagaacgggattttccaaagaacacccggatgaggttgtccgttttctgaaagtgttcaataaagcagttacatggcaaaaggaacacaaagatgaagccgtctccttatatgcgaaaatcaaacatcttgatccgaaagtcgtcagaaacgtgcttaacaatactgagcctctcaatgaaccgatcgatgatgatattgtcaaagcccagcaggaaaccgctgattttcaatatcgaacaaaagcgattcataagaaaattcatgtaaaagacgttgtcgacaattcatttattaaaaaagcgcttgaaacgggggatggcaagtaatgaaagcagaagcatcaacggctgccggcgcaataagccaatcagaaaagaaagctctggcaagatcccggaagtattcataccaatggatgaaagggattgtactcccggctgcggtcatcgcagtatggcagtttatcgcaagtctgggcatcgtctcggccgcggtgctctcgtcgcctgtcgtcatcttgcagacgtttcaggaacttcttctttcaggtgagctttggggtcatttagagatcagtttataccgggcggctgccggatttctgcttggcgcgggcctcggacttgtttccgggctgctggtcggtttttcaaagcggacggaagcataccttgatccgtctctgcaaatgctcaggacggttccgcacttggccgtgactcctctgttcattttgtggttcggatttgatgagacatctaaaattctgctgatcgcattgggggctttttttcccgtatacattaatacgtttctcggaatccgcagtgtggacgcgaagctgtttgacgtcgcgcgggtgctggaatttaattggtatcagcagatgacgaaattaattcttccggcatctctcccgaatatcctgctcggcatcaggctctccctaggcattgcgtggctcggtctcgtggtggcggaactgatgggatcgagcgagggcgtcggttatatgattatggatgccagacaattttcacagacaaataaggtgtttgtcggcattatcatttttgcggctgtcggcaagctgacagatgcattggtcagaatgctcgaacggaaactattaaaatggcggaacagttatgaagggtaacctattaaaaaaggagagattcatatggagattctttggtttattccgacgcatggtgacggccggtatttagggacgcaaacgggagggagaacggcggatcatctttattttaagcaagtggcacaggcggcggacagactcgggtatacgggggttctgctgccgacggggagatcatgcgaagacccgtggctgacggctgccgctttagcgggggaaacgagtgacttgaaatttttagtggcggtccggccgggactgatgcagccgtctgtcgccgcgagaatggcgtcgacaatggaccggctgtcagacggccgtttgctcgtaaatgtcgtagcgggcggagatccttatgaactggcgggagacggcatgtttatcagccacgatgaacgttataaggcgactgaagaatttttaaccgtctggcgcggactcatgcggggcgaaacggtgacatatgaaggggaccatatcaaggtggaaaacagcaacctcctgttcccgccaaaacagtctccgcatccgccattatatttcggcggttcatcacaggcgggaattgaggctgctgcgaaacatacagatgtctatttaacatggggagagccgccggagcaggtaaaagaaaagattgaaaccgttaaaaaacaggctgccaaggaaggaaggacgatgcgttttggcatcagacttcacgtgattgtccgggagactgaggaagaggcatgggaagcggctgaacgattaatcagccacttagacgaagagacaattgcgaaagcgcaggctgcgctccggcgcgctgattcatcgggacaaaaacggatggccgatcttcataacggtgaccgctcgaagcttgagatcagcccgaatctctgggccggcatcggactggtcagaggcggagcgggcacggcgcttgtcggtgatccgcagactgtcgctgatcgaattttagagtatcaggcactcggcattgagtcgtttatcttttcaggctatccgcatctggaagaagcttattatctggctgaactcgtgtttccgcttctgccgtttcagaatgaacggactaacaagcttgagcgcagagtgggtgaagcaatgggaaacgaccattttgcaagaggaaataaagcgacagtctgatgacgtcgcaaggcggatcattgacggcgggcgctttctgcggattcatttccggggaaatgccggcagtgaaggcgggtattcacccgcctttttaagcgcttagcttgcacgatgctcatctggatgatatgatacaaaacgtaattattacgatttgttaggagtgctgaaatggcaaaaaaatcaaaagtaatcaaagagctcaagcggcagaagcttgttgaacaatatgcggacatccgaagagaattaaaggcaaaaggcgactgggaagcgctgagcaaactgccgcgtgattctgctccggccaggcttcataaccgctgtacggtgacggggcggccccgcggatatatgagaaaatttaaactgtccagaatcgcattcagggagctggcccataaaggccgggttcccggggtgaaaaaagcgagctggtaacataaaaaactccggatctgtcatgaaccggagtttttgccgtgcttatgaaaagtgaaaacataagccaaatgctgaatcatcatcagaatgaaaatcaaaagaatcggaaaaaaaggtagatgcggctgaatcagcggataaaacaaaagcagaacggctgcggccggcaatgagaagtaaacggcgatatacgaggaacggcaagctttagccgtcatcattcgttctctttcatcctgttcctcaaattcatcgggcactagcctatgctttttgccgtttcgttttttcttttcggcatagatatacaatgcggcacaaacggtaaacagcagaaacggagtgatattcagctcaaatgcaccgctcccctccgtttggaaaaactgagcgatccgcggcgccgcttccataaaggaaataagcgtccagcaggccaatccgtagagtgcaaggtgaaaacacgcttttcttttcaaactcattttttctcctcctccagccagaaaacttcctccatcggcagggagaaagcccggcagatgttaagcgccaataagagtgaaggcacataatctcctttttcaatcgctgcaatcgtctgtctggtggctccggcttcttttccgagcgtttcctgagaatagccgaatctggctctcagctcttttactttatttttcatcatcagggcgtacctcaagttttcttcttttttatattgtatgagattcttaacaaaatgtaaacctaacttaacatgtggacgaaaaaagaatttttttcgacaaattttttaacattcccttgacgaaaaaaaaatatacatgtaatattagaaacatcaaatcggtactgacaaaaaactttgatgcgggtgtagtttagtggtaaaacctcagccttccaagctgatgtcgtgagttcgattctcatcacccgctccatacatacgttattaacgcagtgtttcgtttctctgataaacgaagtattgcgtttttttatgtgaaaaaagacacgaaggcgtgtctttttatgaaagccaagagacggtatgcgtgcctccgtgaatttgttcaaacattttggttaaagatgatagcagctcatccgccgcgtcggcatgaaatgaaggcgggaaaaagatcagctgcagcattttctttgtgccgattgttacagggcgggtgttgatatgtccggtaaggccgccgaaaatgccgccagagtcggagaaagcaagtacgtgttctttttctccgattgtaatcgaaatcggttcatctatttctgcggcgtcatacgccatgataggcaatgaatatttcaaggagaaaaaaagtatggtatcatgggctgaattcacactttcaatgaatcgttcccgggaaatatcgccgagcataagctccatcggcgttttttgtcctgaaaaggcgggactgagctgttccattatacacgcccactctttaacaaaaggctgctcatctataccgccgtcagcataatcaaagtaaagagattcttgaaataaacggaggcggcctttcagcatttgcggagcaggcccgacttcgatctgttcatataagacggctgccgctttgatccccggcacccgttcagcaataagtggatctaaactgatgttcaagtgtgttcactccatttcgggatgataaaactctattatacccgtgcgggagcctgatcacaaagaaaggaggctgtgcaaaaaatgaatattcataaactgaaagaggaattaatcgaatacgccaaaagcatcggagttgacaaaatcgggtttacaacggctgatacgttcgacagtctgcgggaccggctgattcttcaggaatcactcggctatttatccggttttgaagagccggatattgaaaaacgggttactccgtctttgcttctcccgaaagccaaatcaatcgtcgccatcgcccttgcttatccttccaaaatgaaagatgcgccgaggagcacgagggacgggcggcgcggcattttttgcagagcttcctgggggaaggattatcatgatgtgctgcgggaaaagcttgatctgctggagaattttctccaaagcaaacatgaggatatccgcacaaagtcaatggtggatacaggagaattgtccgacagggccgtggctgaacgggcgggaatcggcttcagcgccaaaaactgcatgatcaccacgcctgaatacggttcttacgtctatctggctgaaatgatcaccaatctgccctttgaaccggatgtgccgattgaagatatgtgcggtacgtgcacaaaatgtctagacgcgtgtccgaccggcgccctcgtcaatcccggacagcttaacgcccagcgctgtatttcgttcctgacccagacaaagggatttttgccggatgagttccgcacgaaaatcggaaaccgtctgtatggctgtgacacgtgccagacggtctgtccgattaataaggggaaagattttcatcttcatccgcagatggagcctgatccggaaatcgcaaagccgctgttaaagccgcttttgaccataagcaaccgcgaattcaaagaaaaattcggacatgtatcgggatcatggcgcggcaagaagccgatacagcggaatgcgattttagctttggctcattttaaagatgcctcgtctcttccggaattaacggccttgatgcaccaagatccgcgccccgtcatcaggggtacggccgcctgggccatcgggaaaatcggtgatcctgattatgcggaggaattagaaaaagcgcttcaaaaggagcaggatgaagacgccatacgggaaattgaaaagggactggagctgttatcggtttctgagaagactaaaaccggccggtcctgacatatgtatagagaaaaagcacttggccggagttcaagtgttttttctttataaaatcgtatggtgggtggagcgcttgaagcatattattgaagatttagcggaggcccggcttcattatttaatcaacggaactgagatgaggcagaatgggcaggccggcgatcttgaggtcctgacgagaaaaaaagagctgtttgaaaaacggaaagttgatatcgtgaaagcgaaggcaaaagccgtcattgtcaaaagcagtcttgaggacgacggcacgttatgtgtcatgtacacgattcatttcgaatatttgtgcaaggagcatgacggacacctttacttagaagagcagattgaggaacggactgcatttctctatgatgagcttttgattaaagaccgggaagtaaagaaaaaaccggctggattttctgacggaaacagcgtaattgaatatgagcggagtgaacgggaagatttcgggcgggcgtttcaatacgaccgtctggctgccgtgcagtacgcggagaagttttggaataaacgaaatcccgcttataaaaatttcagcgataattgcaccaattttatttcccaatgtttacatgccggaaaagcaccgatgcgggggcatccgaacagaggctcaggctggtggatgaaggcaagctcgtggagctacagctggacggtcgcgcattcgatgaagatgtatctggcccaatccaaggcagggcttcgcgcagtgcaagtatcaagagctgaagaactgatgcccggagatatcatttgctatgattttgaaggagacggccgttttaatcatacggcgatcgtggtcgcaaaagataaaagcaatatgccgctcgtcaatgcccaaacgtatgacagcaggatgagatattggtcatatgaggattcaacggcgtatactccttccatcagatatgcgttttttcatattacggatgatacgacaaaagagtaattaatgatataatggtgggcggaataaaaaacagaggtgaacatcgtggcattacatgtcgttttatatcaacccgaaatcccggccaatacgggaaatatcgcacgtacttgtgcggcaacagacacaacgcttcatttgatccgcccgctcggattctcaaccgatgataaaatgctgaagcgcgccggactcgattattgggagttcgtcaacgtcgtatatcatgattcattggaagagttatttgaagcatatgaaaacggaaagtttttcttcattacaaaattcggtcaaaagccgcacacatcatttgattactcaaatacggaggaagactttttcttcgtattcggcagagaaacgagcggacttccgaaagaattgatcgaaaacaatatggaccgctgcctgcgtctgccgatgaccgagcatgtgagatcattaaatctgtccaacacggccgcgattcttgtatatgaagcgctgcgccagcaaaattacagagatttgacgtgagaaaaaacgcccgcatccgggcgtttttttattgaataaaaaagacgggcagcagcggtttacggcatttttatatttccgggcttaacaacgtaacagtgttatgttacaatacgttcatcgaaggagctggattcatggaggaacaactgatttctaaaaaagaattgctggaagaaacatcaatttcatacgggcagctgtaccggtggaaacggaaaaatttaattcctgaagaatggtttatccgaaaatcgacgtttacaggccaggaaacattttttccgagagcggaaatattaaaacgcatctcaaaaatacaggaaatgaaagaaaatctgtctctggatgaaatgagagaaatgctgtctccgcaaatgactgatgtcaatataacgtctgcggaactgcttcaaaagggactgatttcaaaagccgcgctgcaagtttatggcgaagacggcgtgacattcacgtcccgcgcgctgctgtctttatatgtgcttgaagggcttttgcaatcgggcaatatcagccttgaggaaggaaaattggcggcgggggtgctgaagacgtatgaggcttccgagctgaaagcgaatacggagcttgtcatgctccgaaagctcggcgtaacgacgtgcttcatcgcagacgcggaacatattttatttgaaccgactgtcaaagtggttgaacgggtggcgcttgctgcggcatcggaagaattaaaaacgaaatggatgcaggaggaccatcaatggaagtaacagataaattaatcattaacggttcgggaagttcaaaaggaggccgttttcatacagtggagatcaacgggagcggcacggtgtcaggtgatgtggagtgcacgagccttttgtttaacggcagcggaaaaacagacggacatgtcaagacgcaaacactgacaatcagcggttcggggaaaatttccggcagtgccgaagctgaatccatccgtatcaacggaacgggtgtcattaaaggtgatgtcaaaacggagcggctgaacgtcgcgggattttcatctttcggcggcggtgtgaaagctgatgatattttcatatccgggaaagccgggattgaaggtgattgcgagacagagacattccgttcggaaggcaaatgcaagatcggcggcctgctgaatgccgatgaagtcagtatgaagctggctgcgggagaaagtcatgtgaaagaaatcggctgccgccatttgaaagtgatgagcagaaagagcgtgcttacgcgttttaagctgatgccggccccggtgctgacagcagagctgattgagggtgacatcattgaattggcggacacgaacgcgaagacagtccgcggaaatcatgtgcggatcggcgcgggctgcaccattgggacggtggaatacagcggcgattttacatgtgatcctaccgctttggttaacaaagtcgtgaaacgataggaggagctgcaatggaaacgacaaaaaaattgagtcatttaaaaatgtacggagccggacacgcttccggcggttcctaccaaaatgtaagcattaaaggggaaggaactgtcggcgaaggacttcaaagcgaacgctgccggatattcggcacgggactttttctcggagatgccgagatcagcaggctgaaaattttcggagagcatgaagttgcaggagatttatcagcacattcagcaaatgtgatcggcacattgaaagtcggcggctccatgcgttttgccaggatgaggctgaagggacttgctgaaattggcggcggggccgcgggagaacagtgtcatataaaaggcagtctcaccgtcggcggcgattgcgagacggagctgcttcatgtaacaggatgtatcaatgtggcgggattgttaaacgcaggggacgtaaacatccatttgcgttatgaccgaagccgcgtgaaagaaatcggcggcacatcgattaccgtcagacggaaacccggttttcttaaacggaaagccggcatgctttctgctgaattgatcgaaggagacgcaatttacctcgaatccacggaagcggacatcgtcagagggaagcgtgtggaaatcggcccgggctgcaaaatcggaaaaatcgagtatcaaacaagctgtaagtctcatgaaaaatcaactgtccaagaacatattcaaatatgaaacattgttatgttgtacaggaaagggtgctcttcataaagagcacccttttgccgttatttgttttcaggtttgctgtcgtaacccgcagtaaaaatggatactaaaaaagtgagaatgaccccaagtaaaatgatcgttttcatcatgtctcctcctctttgcttttccatttgatgtccgagtctggatgaaactgtatttctttcattatgaacggtgcaccggacccttgtcaatgacggccttataacgtctttatttttaagaaacgaaaagcatgtattatcacgtcaccgcatagattgtaacaaagtaccttatttctagtgcattaaccatgatagaggaggttcttatggatatattaaagaaaattgaaaagtacagagaggaagagcagcgtctcaaatgggaagggacgttcgctgattatttggagatcataaaagaaaatccattggtcgcgcagtctgctcattctcgcgtttttaatatgataaaagacagcggaatcgaggaggatgacgggaaaaagacatacagctttttctcgagggagctgttcggccttgaggaatctctggaacggctcgtggaggaatactttcacccggctgccaagcggctcgatgtaagaaaacggattttactattgatgggacctgtcagcggcggaaagtcaactcttgtcaccatgctgaaaaaagggcttgaagcctactcattgacagataacggcgctgtttacgccattaaaggctgcccgatgcatgaagatcctctccatctcattccccatcatctgcgcgacgacttctacagagaatacggcatcagaattgagggcagcctttctccgcttaatgtcatgcggcttgaagaagaatacggcggcagaattgaggatgttaaagttgaacgtatattcttctcggaggataaacgtaccggaatcggaaccttcagcccgtctgacccgaaatcacaggatatcgccgatttgacggggagcattgatttttctacgattgccgaatacggttcggaatcagatccgcgcgcttatcggtttgacggtgaattaaataaagcgaaccgcggaatgatggaatttcaggaaatgctgaaatgcgatgaaaaatttctgtggcaccttctgtcactcacgcaggaagggaatttcaaagccggacggtttgcgctcatctcagccgacgaattggttgttgcgcatacgaacgaaacggagtaccgctcgtttattgccaataagaaaaacgaagcccttcactccaggatcatcgtgatgcctgttccttataatttaaaggtgtcagaggaagaacggatttatgaaaaaatgatttctgaaagtgatgtttctgacgtacacatcgcccccatacattaaaagtggccgcgatgttttctattttgacccggctgaaggaaccgaaccgctctgatattgatctcgtcaaaaaaatgaggctctatgacggagaaagcgttgaaggttacaattccgttgatctggaggatatgaagaaggaattccatgatgaaggaatgagcggtatcgacccgcgctatgtcatcaaccgcatttcctcaacgattatcagaaaaaatatggaatccatcaattcgcttgacgtgctgcgttccttaaaagaaggactcgaccagcatccgtccatctccgccgaggacaaagagcggtatatgaattttatttccgccgccaggaaagagtacgatgacatcgccaaaaaggaagtgcagaaggcgttcgtttattcatatgaagaatccgcgaaaactctcatggacaattatttagataatgtggaagcgtactgcaataaaaataagcttcgcgatccgctgacgggtgaagaaatgaatcctgacgaaaaactgatgagatccattgaagagcagatcggcatttcagaaaacgccaaaaaagcgttccgcgaagaaatcttaatccgcatatccgcctatgcaagaaaaggaaaacgctttgactataattcgcacgaaagactccgcgaagcgattcagaaaaagctgttcgcagacttaaaagatgtagtgaaaattacgacctccaccaaaacgccggatgaacagcagcttaaaaaggtcaatgaggtagtggcaaggttaatagatgaacacggctataattcgactagcgctaatgaactgctgaagtatgtcggaagcttgttaaaccgctgatatttgatttcattgagaggcccgtctgtaaaaggacgggttcttttgtctgtttttcgcaattgtttgtcaattggagagtccggccggcataagataaaaataaatcttttcgccggacttgtttcataaacaggaccaagccggaatacacatgtaaaacgaccataacggttaaggaggggaattcatgtcccgtaatgacagcggaaattttttgatttcagaggaagactggtccctccatcgcaaaggctttgacgaccagcagcgccaccaaaagaaagtgcaggaagcgataaaaaacaaccttccggaccttgtcactgaggaaagcattattatgtccaacggaaaagatgttgtgaaaatcccgattcgttcgcttgatgaatataaaatccgttataactatgataaaaataaacatgtcggccaaggcgacggcgacagcgaagtcggcgatgtcgtcgcaagagacggcgcagataaaaagcagggcgccggaaaaggccagggagcaggcgatcaggcaggcgaggattattatgaagcggaagtttcattgatggatctggaagaagcgctgtttcaggaattagaactgccgaatctgcagcaaaaggaaagggacaatatcgtccataccgatatcgagttcaatgatatccggaaaaccgggctgacagggaatatcgataagaaaaggacgatgctgtcggcctataaacgaaacgccatgacaggcaagccgtcgttttaccctatttatccggaagatctgaaatacaaaacatggaatgatgtgacgaagccggaatcgaaagctgtcgttttagccatgatggatacaagcggttcgatgggcgtatgggaaaagtatatggcgaggagtttctttttttggatgacacgatttttacggacaaagtatgaaacggttgatatcgaatttatcgcccaccatacggaagcgaaggttgtgtcggaagaagattttttctcgaaaggcgagagcggaggcaccatctgttcctccgtttaccggaagtctcttgaattaattgatgaaaaatatgaccccgcccgctacaacatctatccgtttcatttttcagacggagataacctgacttcggataacgcccggtgcgtaaagctcgtcaatgacatcatgaaaaaatcgaatctgttctgttacggtgaggtcaatcaatataacaggcattccaccctcatgtccgcctataaaaatgtcaaagatgataaatttaaatactacatcctgaaacagaaatcggacgtatttcaagcgctgaaaagcttttttaaaaatgaggaagccggtataagcaaagcatcgtattaaatataaagccgagtgaagaatcgtgcggccgcggttcttcacccggcttttttaaattaaaaataaagagaaaaaacggcataaaaaaaatccttaaaaaatgaaacttttctctttacaaaccttctttcatttattaatattttatcttgtgaactattattaagggaatgaggtgaaaatacggtgattgaatcagagctcgctttgctcagttttgaacaactgtttgatacttccagatcgatttacaaaaagcagaaaatgattctggagacagtgcttgaaccttttgatattacagtgctgcagtatctgctgatgttcaaaatacataagagcaaaagcacgcagctttcaaggctggctttgtcgcttgatctgaaaccggcgtctgtcacgagaatgaccgatattctgtataagcgccgcctaatggttcggagcgactatcacgacgaccggcgtgttgttatgattcagttaaccgaagagggggaagaacttctaaagaaagctgctgttcaatatgccgaaaaagcggcggtcttataccggcagctcaataccgctgaactgcagtacctgcgcaagcttgcggaaagtttaacgaagcttgcaaacggctgtgcagtgaaaaacggaaaataaaaaaatccccacatatttttatcatcattccacaaaatgatagaggaagaaacgaaaggagaaaacaaaatgaacagaggacgtttaattctgaccaacattatcggtttgattgttgttcttgcaattataggcggaggtgcttactactattatcaaagcacacactatgtaaaaaccgatgaagcgaaagttgccggcgacatggctgctatcacagctcctgctgcgggtaaagtaactgactggaaccttgatgaggggaaagaagtaagcaaaaacgacgtggttgcaaaaattaaaggacagcaaaatgctgacgtaaaagccatcatggatggaacaatcgtgaaaaacgaagtgaaaaacggccaaatggtgcaagccggtacgacaattgcccaggaaattgacatgaaacacctttacatcactgcaaacattaaagaaacagacattagagacattgaagtaggaaacaaagtagacgtaattgttgacggcgatcctaatacaacatttgacggaacagtagaagaaatcggttatgcgacaaattcaacatttgatatgctgccttcttcaaactcaagcggcaactacactaaagtaacgcaaaaagttcctgttaaaatttcactcagcaacccatctgacaaggtgcttcctggtatgaacgcatctgtaaaaatctctgaataatacagatcagtcatcaaaccatgaagggaggttgtcttaggtggctaaatcagataatcaagtaaaaagtcctaaaacattgcttattgtgcttatggccgggttattcctggcgatcttgaaccaaacgcttcttaacgtggcgatgccgcacttaatgaccgagttcggtgtgagtgcgacgacgattcagtggcttacgaccggatacatgctggtcaacggtgttttgattccgttatctgcgttcttaatcacccggttcggacagagaagcctctttctcgtagccatgttctgttttacagcgggaacgttagtctgcggaatcgcgcctaacttctcaaccatgctgatcggccggttaattcaggcggtcggcggcggtatcctgcagccgctggtcatgacaaccattctgcttatcttcccgcctgaaagcagggggaaaggaatggggattttcggtcttgcgatgatgtttgctccggcggtcggaccgactctatccggctggatcatcgagcattacacatggcgcattatgttctacggccttgttccgatcggggcaatcgttattatcatagcgtttttcctctttaagaacttggtggaaccgcaaaaaatcaaactcgacagcttgggtgcgattctatctattgtcggattcgcctcattgctttacggagtcagtgaagcgggcagcgacggctggggagatccgatcgtgctgtctaccgtcattgtcggtgtcatcgcgattgccgcgtttgtcattcagcaattgcgctctgaaaaaccgatgcttgacttccgggtatttaaatatgatattttctcactttccagtgtcattaatatcattattaccgttgcgctttacacaggaatgttcctgcttccgatttacctgcagaacttagtcggctttacggcgctgcaatcgggtctcttgctattgccgggcgcgattgtcatgctgatcatgtcgccgatttccggtattctgtttgacaaaattggtccgagaccgcttgcgattatcgggctggtcatcacggtcgcaacgacattccagtacacaaaattgacaattgacacaccttacacgcacatcatgcttgtctatgccatccgcgcattcggtatgtcactgttaatgatgcctgttatgacagccggaatgaaccagcttccggcacggttgaacagccacggcacggcgatgagcaacacgctccgccagatcagcggatcaatcggaacaagtttgatcacaacgatttatacgaaccgtacgacaatgcattattcgcagattgcggataaaacaagcacggctgatccaagcttcatgcagtcgttccaaagcgcggtttcgaatttaatggtcaacatgaacatgtcgcttgatgcggcgaaacaaaccgtttattcatatctctacaaaacagcttcactcaattccaacgttatggggattaatgacgcgtttatgtgggcgacgatctttgcggttatcggcgtagtcctgagtctgttcttgcgtgacgtgcggaaagacaaacagcgggcgaagaaaaaagaggagctgtcattgcttccggcccctaaagaagtgaaggaatcttaatcatctgaatgggaggtttcctgaatgaaaatttacgtagtgtacgatagtgaaggcgaacacacaaaacatcttgctgaagccattgccgagggcgcacgagaaaacgctgaggctgaagtcctgatcgaccatgtcgatcaagcagacatccgcaagctgaaagacatggatgccattatctggggatgcccgggacactttggcaccatcagttcaggcttaaaagcgtggatcgacagactcggctatctgtgggctgaaggcgagctgattgataaagtcggcgctgtattctgtacgacggcgacaacacacggcggattagaaatgaccatgcacaatctgatcactcctatgtttcaccaaggcatgattgttgtcggtcttcccggcaacgttcctgaaaacgcgctgtacggctcttactacggcgcgggcgtcacatgcccggttgacagcgatgtgctgatgacggaagaaggccttcaattaggccgtgcgcttggcagacgtgtcagccaggtcactggtaatctaactgccggacgacagtaaggagagggttatatggccattattatagcggttattgctgctgtcattgtgattgcacttcttatcaccttcaatgtccgcagcacttctgcaggacaggatgtcaaagaagaaaagagagaagcgatcggcactacagccgaacagccggaaaagcatgatccggccgaggagcgctcagccgagcatgctcccgtcgttgtaaaatctgaatctccccgtgagaaaaagaatacaatgggcgatgatgtgtaccgtcaggcgcttcagaagtttaagacttctgagacggatcaggaaccaaacgatcctgatagcggcggcaaaatgcaggatagcagctatcgtgatgcgctgctctccttaaaaaacaaaaagaagtaattgaaaaggcaaatccgcgtaagagcggatttgtcttttttttattgaagatattgtaatacgtgatgatctagtgtactatgttactcatacacttgatccgaatggagagagaaagaatgacatcgtttttaggtttgctgaaaaaagatgcgaaagtttcatggatttggctcgcggtgtggctttgcggcatgatttgctgggcgttttcagcccacgtcatcgctgcccgtcagaaagaaccgctcgtcattttcggcttttttacggcaatggggttttttcaatttcttgtagcgccgctttttatgtattatcaccttcataaagaaggaaaaaaccagctgtggctttacaatccgaatgggggattttatctgctggcttccaagctgacggcctcactgctgtatcagttgatcgggcagctggcgctgacgggttacggcatttggatgtaccggatgctttctgcaaaaggagtgctggaacacaccattcccctggccggcacattaaccgggctgaatgcttacctgctgatcagttcagcgtacttatctgtgatcgtggccgtattttggactgtttttcactcattaaaacattttcccgtcctccgttgggggatctgcatcgtgcttgcgtttgtctggacctatattgacgataaaatcattacgcctttcacttcatctcaacatgatttatggccggtaaaagtgtatgcgaattttcattttcattatacgaaattgtccggatggacgatggagctgaaagccgtccacatttcgcttttcagctttctggcagtgatcgtgcttgcagcgctctgtctcgcgctggcctctatactgctgaatcgaaaggttgaggtgtaatgatggagaatgaatttcagtcatccaagcccatttatctgcagattgccgatcgtatatattaccggctgatccgaagtgagctttcaccgggggacaaactgccgtccgtaagggagatggccgtacagatgaaagtgaatccgaacacgatacaaagaacgtacagtgaaatggaaaggctggggatcgtggagacgagaagaggacagggaacctttatagcggaaagatccgatctgaaagcagagctgaaagacaggctgacaaaagacgttttcaaacgctttattcaggaaatggcggagctggggttatctcctgaggaaatgctcgaggggatcaaacaatatgcggaggaagcaaacgatgaatcttgattttgaacgcgtaacaaaaaaatacggccgcaggatcgcggtcagcgatgtatcattttcattgtctccgggtaaaatctacggaattttagggccgaacggaagcggtaaatcaacaacgcttaaaatgcttgcagggcttgcttttccgacatcgggcgccgtccggatgggagagtgcaaagtaagcaggaacatgctgtttcgtacggcttatttaaccgaacatgatatgttttccgcccggacgaccgtcggtgatatgctcacgttttatcattcgcaattcccggattttcagctggaaaaagcacataacctattagcggaaatgaatctttcagcgaagcagaagttaaaagagctgtccaaaggcagccggggcaggctgaaaatcgttttggccctgtcgagaaaagcatcggtcattctgctggatgagccgttttcaggtcttgatccggcggtcagggagtcgattgtcaacagtctcgtatcttatattgattttgacagtcagatcgtcgtcatcgccacgcatgagatcggcgagattgagacgctgttagacgaagtgatggttttcataaaagggaaaatcgctgaacggcgcgaggtcgaagaaattcgggaacaggaaggaatgtccgtgctgcaatggtatagaaacgtcatgcaggcgcacgaaatagaagggggattctaattggaaacggtattagaactgcaacaggtaaagaaaacgataaaaggacgaacgattattcatgatctgagcttctccgtccgggcgggcgaagtgtttggatttttagggccgaacggagcggggaaaaccactacgatcagaatgatggtcggattaatgaaactgtctaagggagacatcgtaatctgcggggaatccattacgaaaaactatgcaaaagcggtcaggcacgtcggagccatcgtggaaaacccggagctgtacaaattcctgagcggctataaaaatttacagcagtacgcaaggatggtaaaaggcgttacgaaagaaaaaatagatgaggtcatcgagctcgtcgggttgcaggacagaatacatgacaaagtaaaaacctactctctcggaatgagacagcgtctcggcctcgcccaaagcctgctgcataatcctaaggtgctgattctggatgagccgacaaacggcctcgatcccgccggcatcagagaaatcagggaccatctgaaaaagctgacacgtgaaaaaggaatggctgtcatcgtctcaagccatcttctgtcagaaatggagctaatgtgcgatcgaatcggcattctgcaaaaaggagagcttgtcgatattcaaaaagtaagggatgaaggaaaagaggataaagatacatacttcttccatattgaacaaagagaagaggctcttgccgttttgagtcagtttgactgtgtgaagaagacaaacggcattgagatccagctgtccaaacaggaagtgcctgatgtgatatcactgctcgtccgtgaaaacatccgcttatatgaagtgaaaatcatgacaaaatctttggaagaccgtttcttggaaattaccggcgggacgaaagaggaggttcaatatgtttaagctgatctataatgaatggattaaaattttcagccgcgtcggcacgtgggctatgattgtgattttaggcgtttcgatgatcggttttgcgcttctgtcaaaccatttcacctcgaacgaagccaatccgaattggaaacaggagctccaggctgaaaacaaagaaatgaaacagcagatgaaggaaaccggaaatcagacgctcattgataacctgaaacagaatgtcgcgataaatcaataccgtatggatcataacatccccgaggatacagggtacacagtgtggtcatacgtatctgattcttcgatgatgactgttttgaccgggctgtttacgattatcattgccgcaggcatcgtggcgaatgagttcaactgggggacgatcaagctgctggccatccgtccgctcagccgttttcagattttgctttctaaatatatgacagtgctgctgttcggactgctgatgcttgtgattttatttgccggctccgctctgttgggattggtctttttcggtacaggcggagatactgcggctgatgttcatctcgtatacaaagacggccatgtttttgagcaaaatatcatcgctttcctcgctaaaacatatgtctatgaatctgtctccgcttttatgcttgcgacgatggcgtttatgctgtctgcggtattccggaacagttcattagcggtcggattttctatttttctattggttatggggaacacggcgacggtatttcttgctgcgaaatttgaatggaccaaatatattttatttgcgaacacggatttgtcgcaatatatgaacgggactcctttagtagaggggatgacgatgacattttcggttgtgatgcttgtgatttacttcgttatttttctggcgcttgcattcggcgtcttcttaaaacgggatattgccacctgatataaaaaagctgttttgcctttgcaaaacagcttttcgttttagatgaaaaaaacctgccggcgtacaccggcaggtttttttaaacaatttatgcttttgttacgttagcagcttgtggtccgcggtttccttcaacgatttcgaaagaaacagattggccttcttctaaagttttgaagccttcgccttgaatagcagagaagtgaacgaatacatcgtcttgaccttctacttcgatgaatccgaatcctttttcagagttgaaccattttactttaccttctaacatgaaatttcctcctaaagcgacaaacgcttaaattcactattcttgctctaaaacaaacttccaagacgaaaactcttacaaaactttcttcttaaagatagttcgaacaaaaataattacctttactctaccagtaatccgaagaaaaaacaactgctaaatgtaacttttttcgaaataacatgttttaagaggaaaacgctctgatacggaaatctgatttgagaccagaacagcccatttgcagctgataaaaaccgctttgcagcctcttaaggaagcaattgacaaccctttttttaatcggtattgtatgtaatcatgagcccgaataccatggtgcagcttctgtacataaaaatagatagggagtaggtcaacttgaatctgcggcttataaacagtctgtttcttttcattttgatcatgtcacttacttcatgcgattatcctgacgggaaccggaccattactatcggaatcaatgaatctgatcaatcgatctgggagtttgtcgcgaaaaaagccggtgaggaaggattgcagctttctttggtaacgttttcggattatgctgaggccgatttggcacttgccggcggggatctcgacgccaatgcgtttcaatccgttactaattttaaatctttgccgcctcacgtgaaaaagaagctggcccctttaggaacgacatatgcggcatcgctgggggtgtattccaagcaacataaacggctgaaggatataccggacggagcggtcattgccgtgcctgatgaagcggcggccttcggcagggcgctttttctcatgcaggaggccggactgattacattgaaaaagggattcagcggtacggggtcaacggatatgatcaaggacaacccgaagcatctgaccttaaaaacggaaacaaaaaagaacgcctatcaggcggcggaacatgctgacgcagcagttctcagtcaaagcgaggcgaaaaaagcaggatttcatgcggagaaggacgcgctgatccgatcggcgcaaatgaaggaagcgtatattcatctgatcgccgtcagagctgaggataaagatgatgaacggatgcaaaaactcctgtctttgtatcaatcagatgataccgcggcgttgattgaaaaagaatatgagggcagcctgattcccgttttcctgaggggcggctttctcactgaaaagaaagaatgatttcctcttcgggcgatcattcttttttttcagtgctgcacacttgattgcgccctgatgttttcgctttgtacagcatccggtccgcgatcaggggcaatgtctgagggtccggtgtatttgtcggataatgcgcgatgccgagggaaacggtcacgggaattgtatctccgctcgtcagcagaatcgggttcgcgtcaatcgtgtgcctgatttcctctgcgaggtgaagcccttttgtatacgtgcaattgggcataagcacggcaaattcttccccgccgatgcgggctgacgtatgagaactgctgagtaagaacctcaggcgcgcccccagttccttcagcacttggtccccttcataatggccgtattgatcattgatctgcttaaagtgatcaatatccaaataaataagcgcgagctgagacgagggggattgagacgtccgatcgtacagaacgcgcgagacttcctcgaattttctcttattaaaaatccccgtcagaaaatcataattcgcttgaaacttgtattgcttgaacaaaacgcgggcatcggcttcgtgtttgatgatatacagtgacagcattccgcccaagatggaaatgagccaataataaacgagggccccggcaggctgttcaggcataagaaacagcagcgtcaaggtgaaaataacatttgaaaaaagcagcataacgaacgccattttatgatccggcttttttcctctgaggacggccgcagaaagtatcgcaataaccccgacggcggcgatggaaaaaatggcgcttgcattgaaattgatcaggatacggcctgcgacgataatcgcaaaggcggctgccgtagacacccagcctccgtaaagagcggcgatgataatggggatatttctgagatcaatgatggaatcggagtaagaaaagccgaaagcaatcagaaaaacccctaaaagcccgcagaccgtccccttcagtaattgaaacatcggacggtcttctttatacgaaagcgactctttaaaaagaagggtgaacagataattaaatgtgattaaaatcgttaaattaagaaacagttccttcagcataacaatcacccttatataagttactagagaaagggtggaaagaaaagagaaaaatcaataaaaatacatatattgtcaatccttacttgaccgatcggaattgatataatatagtgttaaaggataatgagcaagggagtgtttacctgttttggagaatttatttgtagtcttacatgtttttattatgcttttgcttatagcaggtctgtttgtcatgcaaaaaaaacacgtttccttttctaaacgtgtctttaccgcgctcggactaggcattgtattcggttttgcactgcaattgatttacgggccggcatcacatatcgtgacacaaacggccgattggtttaatatcgccggcggcggttatgtcaaattgcttcagatgatcgtcatgccgctagtctttatttctattctcggcgcatttacgaagctgaaactgacccataacatcgggaaaatcagcggactgatcatcggaattttgatcgccacgacagcaattgccgcggcagtcggaattgtttcggcgctttcttttgatctgaaagccgtccatatcgaccagggaagcaccgagttatcaagaggccaggagctgcagcaaaaatctgaggatatgacggccaaaacgctgcctcagcaaatcgttgagcttctgccgggaaatccgtttcttgatttcacgggagccagaccgacttccaccatcggagtcgttattttcgccgctttcctcggcatcgcttttctgggcgtgaaacggaagcagccggagcacgctgcgacgttcagcggaattgtcgatgcggtatacgcgattattatgcgcgtcgtgacgttaattttaagattgacgccttacggggtattggcgattatgacaaagacgatcgcgacaagcgacatcgacagcattgcgaaactggggatgtttgtgatcgcttcatacgccgcgcttatcgtcatgtttatcgttcacctgctgctgattacgttcagcggtttaaatccgatcacatacgtgaaaaaagcatttcctgtcatggtgtttgcgtttacgtcccgttcaagcgcaggggctttgccgcttaatattaaaacgcaaaaaagcatgggcgtccctgaaggaattgcgaacttcgccggttcattcggtttatcgatcggccaaaacggctgtgccggcatttacccggcgatgctcgcgatgatgattgcgccgacagtagggcaaaacccgtttgaaccgggatttatcatctccgtcatcgccatcgtggcaatcagttcattcggtgtagcaggcgtggggggcggcgcgacatttgcggctctgctcgtcctatccgctttgaacatgcctgtcgcgcttgccgggctgctcatttcaattgagccgttaattgacatggggcgtaccgccttaaatgtcagcggcagtatgaccgcagggctgttaacaagtaaaatgacgaaggaaaccgataccgcggtgtacaatgattcctcaatcgtcattgaagctgaagaagcttaataaaaaagcagatagcgctaaaacgaaaaatccttcatcgttgaacgaatgaaggatttttttcgtttctaatgatttccgggttcaatttcttccagcatattcatcacggtgctgtcatttaaaacatttaccgcgctttcttcgaagtgaatcggctcggtatagtgaggcttcggcgaagtttctttactgcggtctgcctgtccgtccgtatgggatgagccggagtgattgcgggaagtctgctcatgctgctgtccgccggattccccgccgaaagcctgtttgatcagctcggcaggctgcacggagcctgtttgtgaatgccgtgctttgtccgtgtgctgctgtccgccggattccccgccgaaagcctgtttgatcagctcggcaggctgcatggagcctgtttgtgaatgccgtgctttgtccgtgtgctgctgtccgccggattccccgctgaaagcctgttgaatcaggtcagcaggctgcatggagtgtgtaccatctttatgctgcattcggcctgaaaccattccggagattttccggcggatttcgggtgataaagctgcaatcagaatcgatgatccgatcagcagcgctgtcgggctgatgccgcttttttgtctgaacaagttaaatccctcctcattcaattgattacgcttacctttccctatccttctgatatttatccaaaccgctcagaatgcaaacggcgtgcataaatcccgccgaatagaaaaacctatacgtaaagtgagaaaggaggaattcacatgataaaaaaacaagcagttatttctgcccttcttctgccgatgctgattaccgcagggtgcagtatggggaaccagggagaaggaaaacgaaatgacaaccgcacccagaatgtaaattaccgcaacacacctaacgacggtgcgacaaatatgaatacagtgaaccgtcataaccaaaacaccgatcacaatgacaaccgtaacctgagagtggctgataaagccgcagacaaggtgactgatttaaaagaagttaaaaatgcgactgtgatcgttgccggaaacagcgcttatgtagccgttgttctgacaaacggacaaaaaggcgccatcgccaaccatttgaaaaataagattaccgataaggtgaaatcagccgataaacatgtccggactgtatatgtatcagcaaacccggacttcgttgaacgtatgcaaggctacggaaaacgaatccaaaacggccacccggtatccggactgtttgatgaattcggccaaatggtgcagcgtgtattcccaaaccccaataaataaatgaatggaaaagccgcatttgctgcggcttttttattttatctgccgtcacgacccagcgcttctgagcataaagtaaagaatgagatgaaaattaaaggatcggggaggggagcttgtttgcgtgacggcatggggaaacgggcggcattcactctgatcctgtgcggagtccttgtcatattggctgtcagttcagccgtttcagtaagtatgatgtacgtcctgtcaggccaaaacagccgctctgttccgacgaaggaacaagtgactgaacacatgaataaagaaatttacaaacatacagcgatttactatacagcggatgaaaagccgctcttggatctgaccaagcttacgctggaccacgcaaagcgtatcaaccaaatcattgtcggctataaaggagcggcgcctcttgaactcattttcttttcggatgaagctgaaatggagcaatactcaggattgaaaaatgtagtcggtttttattcagagcaggagcagatgatggggctcttgccagaagagaaaaaacagcttttgaaaaaagatgagctggccgttttcatgtataagcaattgattatacatgaatatacacactacgcatttcatcaaaaagcgcggcaattggggacggatacgtctgtatttccgctttggtttcatgaggggctgagcgagtgggttgcgcattatgatgtggtcattgatccgattgcattttccgtcgtgccgtttgatcaattaacgaccgaccgaaaatggcagaaatcgcgtatggaatatgaaacggatgtttatttgcaaagtttctatatgataaaggatttaaccgaaacattcggagaaggcattatcttaaccattatcaataaaaccgccgaaacacaggattttgaaaaaggctttgaagcagctacgaaagaaagcctgaaacaatttgaacatgatttcacaaaagcatatgaaaaaaagaaaacggcattggagagtcagctttccaacgccgtttttttcattaatggaggttttgctgctgctgtcccatttgtcctttaatcggaggcatttgcggctgtccctgcgccggcgcaaatgaattcagcatggtctgcatatcttgtgcattgagctgaggaacctgataataaccgtgtttgttttggtataagaagatttcatacgccatttcgacatattgctgaatttgggcggagagcactcttcttgtgacgggattggtcatttcaagcgagctcatcgtcaagagagaagcttgagctttaatcaggccgagcatatggccgcttattccgagatctttgacatcatttaatgattgattcggttttttcggctgagtcggttttataccgtagacggcctggttctgttcctccatcatatatgtcgacgtttcctgagaaggcttttggccggtcttaaagcattctgccgtcagattatagagtccgagaatgaattgatactggcggtcaagaatgtcggccagctgctgatcctgtataaactgtctgagcatcataaattgatccaaaacgccgactgttccggccagcacttcatgcatatcgaaaagctcatgtcctccgtgattcacttgcggtgaacccggaatcccctgatttactggcggctgctgctgattctgctgctgttccactggttgttttcctccttcatgtcaaatcacatttaagatgtgaaaaaagccgatccgttatacatcaagacttatttcgttacgtggggattatttactattttgcgccagcgaagacaatctttacaaaaaagtgatgtgatttttaagaaaataagctaacgtatttcttagaagacaggggggaaatgaatgaagaaaaaaaggggtttgcgtctttcgtgctgtttgctgacggtttgttttatgatgttcagcgtgaaagatgcggaagcaatcggacaagccggatcactgaatgaagctggaacggataaagcgtataaagaacggcagactgaagactccggccgtatcccgctcagaatcatcagcatgaatgatctgcacggaaaaattgatcagcaatatgagcttgaccttaacggagacggtaaaccggatggcactttcggacggatggactacgccaccgcgtacattaaaaaggcgaaagccgagaaagaacacgcctttgtcgtgcatgcgggcgatatgatcgggggcagctctcccgtgtcagccctttttcaggatgaaccgacagtagaattgatggaagacatcggttttgatgtcggaactgtcggcaatcacgaattcgatgaaggaacgaatgagcttaaacggatcatcaatggaggagatcatccggacggtaaggggacaagcggttatgacggccaagatttcccgctcgtctgcgccaactgtaaattgaagtcaggggagtcctttctgccgccgtatgaaatcaaatacgtttccggaattccggtcgcatttatcggggttgtaaccagatcggcggcaggcatggtcatcccggacggaattaaaaatattacgtttacggatgaggtaaaggccgtcaatgacgccgccgcagacctgaagaaaaaaggaattaaagcaatcgccgtgctcgcccatatgtctgctgaacaaaatggctcagccatcacgggagaatccgcaaagcttgcaagcggaacagactcagagattgacgtgattttcgccgcgcacaatcataaagtcgtaaacggagaaatcaacggcaagctgatcgtgcaggcatttgaatacggaaaagcaatcggaatcgccgatctcgaactagataaagagtcgaaggatatcgtgaaaaaatcagcggaaatccaatatatcgatcaaagtaaaatcaagcctgatccggatgcggcaggcatattaagcaaatatgaagagaaagtgaaaccgattatcagcgaagcggtcggggaagcggcccatgatataacgggcgggtattcaaatgacggcgacacggcgctcggaaatctgattgccgacggtatgaaagcgaagatgaaatccgattttgcgcttatgaatgggggaggcatccgggacggcataaaaaaagggccgatcacatggggagatctttataatgtacagccgttcggcaatgtgctgacgaagcttgaaatcaaaggaaaagatttgcgggagatcatcaacgcgcaaatttctccggtgtacggaccggattacagcatcagcggattttcctatacatggaacccggaaaccggacaagcggcggatgtgaaaatggcggacggtacagacatacagcccgaaaaaggatatacagtaacagtcaatcaatttatggcgacggcagcgggggcaaaatacggtccgatcgggaaactcggcaagaatccggtgacggggcctgaggatttggaagcgacagtagactatgtcaaaagcttttccgcaccgatttcttatcaaaccgacggccgcatccgcacggcatcagccgccgaaacacctgatgacaccggcaatcagccgggaagcggggaaacaccgggcagcaccgggcctgataaaggagaaaaacctcaaacggaaaaacccgctaaaaaaccggatgcagcagaacagcctgatcaaaccaaaaaacctgaacgtcctgtcgtaaaagaagcagcatctgatacagtgcagtcaattcccgaatcccgtacggcgtctgccgcagattcggaacaaagcacagaacagactgaaagcggcacacaaaaaggccgcccattgcctgatacttcagcgggcagccatcagacggcattggccggcctggtgatcacgggtgccggcgtatattggcttttcagaaagaaaaggggaacccgcacacgatgaacaaactgaaacatattccgcttctcgtcatcatcgcaggtgttatcatcacatgttacggaagctggaagatcattgattcacatatgaaaacgaaccaatcgcttgaagaagcaaaaaaagcaacagaacctgtcttggaaaagaacgaaacaaaaagcgctgtgcaggcacagcgcaaaaaagaatttcaccccgaaacgggtgaggcaagcggcattttagaaatccctgaaattgacgctgagctcccgatcgtcgaagggactgacgcagatgatttagcaaaaggcgtcggacattataaggacagctattatcctggcgatcacggccaaattgtgttatccggccacagggacacggtgttccgccggaccggcgaactgaaaaaaggagacagactgaacgtgattttgtcttacggcacgttttcttataaaatcagccgtacaaaaatcgtcagccgggatgatacgtctgtcatcacccttcaacacaagcgggaggaactgatcctgaccacttgctatccgttttcttacattggaaatgcgccgaaacgatatattatatatgccgacccggtttaagaaaaatacgtttcggtaaaatgagccagatcagccggcatcggcgcctcggcaacgatttcttctcctgagatcggatggacgacactgacttttttggcgtgaagcgcctgcctgtgaaacagcgccctgcttccgccgtacaggtcatcgcccgccaacggatggccgatgcttgccatatgcaccctgatttgatgtgttctcccggtttccagttcaagctctgccaatgtaagctgcgcaccgggatgatagcccttcactttgtaatgggtgacggcggcttgtccgccgggtgagacgcgccgtctgacggaatgtgacctgtcgcggccgatcggcgagtcaaccgtgccttttttcggcgtgacttttccttccgccgcggcgatataggtgcgttttaatgttttggtttcgagctgacggtcaaggattgcatgggccaggcggtgtttcgcgaaaacgaccgcgcctgacgtgtcacggtcaagacggtgaacgtggcgcactttcgcttgttcgccgttgatttgaaaatggtaagcgatcaggttgctgagggttccggtctgaccctcttcatttggatgagtcggcattcccgccggcttatttgcaatcagcatatgactgtcctcaaataaaatgtccggctctccgtattcaggaattaccgaagaacccgttttttcctgaagatcaatgaataagcggtctccggttttcagtatgatgttgtttttcggggatgtccgattcacctgaatgcttttttggttcatccattccgttatcacgggttttgacgcctggaattcagatttcaggactgaaaacagccattgtccggcgtgtttttccgtaatcaggagttccagaccgcggtcattttgtttcatatcataaagctccttttcaagcggaaagcggctgtttcaataggaaacacttaccttagctttcgcgtttttttctatgctattcttgataaagattaaggatattcacatggcaagaaaggtgattgatgtgagaattgtgaacgcagcgactgacggacaagaaagcgcgatacaagagctttcctctgaattgtttcaaaatgtctttcctctttatttctccgaactggaaattcagcgctttaaaaaaaggggcgtattgtctttacaaaaccaacgttaccaaggaactttaaaagaagcgtttcaaattatggcttgtctgcaaacggtacatatcatgctgtcaaagccgcaccccgtatatgacgtcaaagagcgggcgctgtttgataaaaattgcgctttgctgaatgaatgcggaatgaattttccctttacctatgatgatttcgagacaggggccggatcagaagcctgcggtcacagaaggctgatctgacgggtataaagagccttttgacaggctcttttttgcttccttgacatgataccacaatttctttcctctaactccctttataatgagtcaaatccccgagcataataaaatgcgaaaggggtgctttacaatgagttcaatcaaacaatcaatgactacccacgtggctaccgtttctcccaaccaaacgatccaggaagcggctgcgctgatgcaccagcataatgtcggagcaattcccgtcgttgacggaggggaattaaaaggaatgctgacagaccgtgatatcgcattgagaacaacggctcaaggccgcgacggccaaacacctgtttcacacgtgatgtcttctcaagttgtatccggaaacccggaaatgagtcttgaagaggcgtcacatctgatggcccaacaccaaatccgccgccttcccattgtcgatcaaaatcatctggtcgggatcgttgcgcttggagacttagcggtcgatcagcgttcaaatgagtctgcgggagcggctctttccaatatttccagtcaaaacacacagtaacggatgaagagagcttgcactcatgcaggctcttctttccgtgagaatgttacattttgaatgcaaaagaaattcacggtatagtgtatacataggtcagtacgtttagctaaaggagctgtaaccattgataaaagcattaatctttgattttgacgggttaattttagatacagaaacccatgaatatgaagtgctgcaggaaatgtttgaggaacacggttcaacattgcctttatccgtctggggaaaggtgatcggaacggcggcggggtttaagccgttcgcatatttagaggagcagctgggaagaaagctcgatcatgatgaactgacggcgatcaggcgcgggcgcttcgaacagcggatgaagacggaaacggcgcgtcccggagtggaggcttatttagccgcggcaaaagaattaggattgaaggtggggctcgcttccagctcagattttaaatgggtgtcgggccatctgaaggaattaggcctgtttgatgaatttgaagtgattcagacggctgacgacgtagaagaagtgaagcccaatccgaagctctatctgaaagctgcggaacatttaggcgttgaaccttctgaatgtcttgcctttgaggattcggtcaacggctcaatcgcagccaaacgcgccggcatgaaatgtgtcatcgtgccgaataaggtaacgagcgccctgttatttgaagaatacgatcacagactggaatcgatggcggaaatggaacttgaattactcttacagcgattgaacgatcaaaacgaaccggcagggggaagcagcattgtctgagaaacttgatctgacccgttttgaaaagaaaatggtcatacggaatatggaagagaaagatatcaacaaaattattgagctgcaaaaggattgttttccggggatggagccgtgggagcctgagcatttaatcagccatctcgcgcactttccggaaggtcagttttgcgccgagtatgaaggggaaattatcggttcatgctcaagcctgatcatcaatttcgatgaatatgatgaccgccacacgtggcaggacattacagacgacggttatatcacgaaccacaacccggacggattgaatctgtacgggattgaggtaatggttcacccggaatacaggcggatgaaaatcggacaccggctgtatgaggcgagaaaagacttggcgagacgattgaatctgaaaagcatcattatcggcgggcggattccgaattatcataagtatgcggaagaaatgacggcgagagcctatgtcgaacaggtgacgcgccatcagatttatgacccggtgctttctttccagctgatgaacggatttacgctcatgcggatcaatccgaattatctcccggatgacaccgcgtccattaaatatgcgacattaatggaatggaacaatgtcgattatctgccgcagtcaaagcgctattacaaatcggcatttccggtgcgcatctgcgtcattcaatatgaaatgaaaaagatttattctttcgaggaatttgccaatcaggttgaatattatgtcgatgtggcttcagatgcgagatctgatttcgcggtattcccggagattttcacgacgcagcttatgtcatttctcgaagagcgttctccgagtctggccattcagaggattaccgaatataccgaggactatatcagcctctttacagatctcgcggtgaaatataatgtgaacattatcggcggctcccacttcgttgaagaagaggggaaaatttataacatcgcctacttattcagacgtgacggcacgattgaaaaacaatataagcttcacattacgccgaatgagcggaaatggtggggcatcagcgccggagacagggtgcgcgtatttgatacggactgcggaaagatcgccattcagatctgttacgatatcgaatttccggagcttgcgagaattgccgcggatcaaggggcgaaaattatctttacgccattctgcactgaagaccgccaaggctatttgcgcgtaaggtactgctctcaggcgagagcggttgaaaaccaaatttacaccgtcatctcaggtacggtcggaaacctgccgcaaacagaaaatatggatattcaatacgcgcagtcagccatttttgctccgtctgattttgaattcgccagagacggaatcgtcggtgaaacgaatccgaatatcgaaatggtcgtgatcggggacgtggaccttgaaatcttaagaaggcagcgtgaaaacggaaccgtgcgccagctgaaagaccggcgcaaagacatttaccggattacgcatctgaaataaaaaaacgcccgccccgcttaagggcgggtttttttataaaaacacttgcaccggccccggtttcgggatatgctcttgtagccctttcgctttctgggagaaagcgtttttttaattgccgccgctttattgactcgcccatgccgcgcctttatattcttattaagaggaaaacttcaccatgagaatcggcgtcagaagccgggcagctttcgatacagtgcaatgatattgaaagggagatgagcggtgtggaacatgtacaaaaaaatcagtcactcaaacaaaaggataaagagctgatttggcacgcgatgaaaggggcggagccggatgacagcataatcgtccaaaaaggggaaggcgcctgggttacggacattgacggcagacggtatttggacggcatgtcaggattgtggtgcgtcaatatcggatacgggagaaaggagcttgccgatgcggcttacagccaattgaaggagcttccttattatccgctgacccaaagccatcaacccgcgattgagcttgcggaaaaactgaatgaatggctcggcggcgattatgtaatcttcttttccaacagcggatcggaagcaaatgaaaccgcgttcaaaattgcccgccaataccacattgaaaacggcgatcacagccgcttcaaattcatctcccggtacagaggctatcacggcaatacgatgggggcgctcgccgctaccggccaggcgcagagaaaatataaatatgagccgctctcacaaggttttttgcacgcggcgccgcctgatctttatcggaatcccggcgatgccgtcacattggaaagcgcgcatgaaatcgaccggatcatgacgtgggagttaagcgaaacgattgccggcgttattatggaaccgattattacaggcggagggatactgatgccccggacgggtatatggcaaaggtagaggacatttgccgccgccacggcgcgcttctgatcagtgatgaagtcatttgcggtttcggccgcacgggagagccgttcggatttcagcattacggcgtttcaccggacatcgtcacaatggcaaaaggcattacgagcgcttatctgccgctgtcggcaacggcagtaaaacgggagatttttgaggcgtattcgggcggtgagccgtacggccgcttccggcacgtgaatacattcggaggcaatccggcagcctgcgcccttgctttgaaaaacctgcaattgatggaggacgaaaatctgatcgcccgctcccgggagcttggagaacggctgctccgtgagcttgagccgctcaaagaacatccggcggtcggcgatgtacggggcaaaggccttcttgccggcattgagctcgtcaaggacaaaatcacgaaggaacccgctgatgccgctcttgtgcagcacgtcatcaccgcgtgcagagaaaaaggcctgcttgtcgggaaaaatggtgatactgtagcgggatataataatgtcattcagctgtcaccgcctttttgcctgtccgacgaggagctctctttcatcatttcgaccgtcaaggaaagcgtgctgagcattgatttttaaagtaaaggagtaaaacatgagttttcacaaccagaagattctaccggctatccggaacatgaagcaattcgatgcatttttagagagtccgttcttatacggcgtcattttagatatacacctcggtcaattaaaaggtgtcgtgaatgaagcgaaaaaacacggaaaacttctgatggttcacgtcgatttaattcacggcattaagcatgacgaatacggtgcggagttcatttgtcaggacatccggcccgcgggcatcatttcgacgagatccgccgtcatcgtcaaagcgaaacaaaagaaaatatacgcgatccagcgtctgtttctcttggatacgagcgccatggaaaaaagcatggaattcgtcggaaagcataagcctgactttatcgaggttctcccgggcatcgttccgactttaatcagagaaattaaagaaatgacggggattccgatttttgccggcggcttcatccgcacggagcaggacgttgaaaacgccttgcaggcaggagccacggccgtgacgacttcagacaccgaactatgggctaaatatgaacattctatgacaaaaaaagattgacaccgcttacacccattgttacaatagacctaggttaatactatgtgatggagacccggagacccacaacagctctttacggaagcaataaagcgtaaagcggtttgttgtgggttttttattctctataactctgtcaaacctgctattttgtcatttaggaggaatgatgatgacagcattttggggagaagtaatcggtacaatgctgcttgttattttcggcggcggcgtttgtgcgggagtcaacttaaagaaatcgctttcataccaatccggatggattgttattgtattcggctggggattgggagtagccatggcggcatatgccgtcggcagcatcagcggcgctcacttgaatccggctttaacgataggccttgcgcttgaaggcagctttccttggaaagacgtccctgtttatattgcgggacagatgatcggagcaatgatcggtgcggttgttgtgtaccttcattatctgccgcattggaaggcgacggatgatccggccgctaaactgggcgttttctcgaccggcccgagtattccccatacatttgggaatatgataagtgaagtcattggtacgtttgtgcttgtgctcggcattttggcaatcggagcgaatgaatttacaaaagggctgaacccgctgattgtcggattcctcatcgttgccatcgggatttctcttggagggacgaccggatatgcgatcaaccctgcgcgggatttggggccgagaatcgctcacgcctttctgccgatcccgaaaaaagggccgtcaaattggaaatatgcctggattcccgtaatcggtccgatcatgggcggtgcgttcggcggcgtattttacaatgccgcgtttaaaggaaatgtgacacctagcttttggtttgtaagcgttataatggttgtagtgcttttcatactctatatttataccaagaaatctcaatcacagaaaacattatcaaattctgaatatatttaaaaaggagagcggcatcatggagacctatattttatcaattgaccaaggcacaacaagttcaagagcgattctttttaataaagaaggaaaaatcgtgcattccgctcaaaaggaattcacacagcatttccctcagccgggctgggtggagcacaatgcgaacgaaatctggggatcggtgctcgccgttatcgcgactgtgatttccgagtccggaatcagcgctgatcaaattgccggcatcggcatcacgaaccaaagggaaacgacggtcgtatgggataaagataccggaaagccggtatacaatgcgattgtgtggcaatcgagacaaacatccggcatttgcgaagagcttcgtgaaaaaggatataatgatacattcagagaaaaaacgggacttttgatcgacccttatttctcaggaacgaaagtcaaatggattcttgacaatgtagaaggcgcgcgggaaaaagcggaaaacggaaatcttctgttcggaacgattgattcatggctcatctggaaaatgtccggaggcgcggcgcacgtaacggattattccaacgcttcaagaacgctgatgtttaatattcatgaattaaaatgggatgacgagctgcttgatattttaggcgtgccgaaatccatgctgccggaagtgaaaccgtcttctcatgtgtacgcgaaaacggttgattatcatttcttcggtaaaaatattccgattgcgggagcggccggagaccagcagtctgcgctgttcggtcaggcgtgctttgaagaaggcatggggaaaaacacatacggcacaggctgctttatgctgatgaataccggagaaaaagccatcacttctgatcacggccttctgacgacaatcgcctggggattagacggaaaagtcgagtatgcgctggaaggaagcatctttgtcgcaggttctgccatccaatggctgagagacggcatgcggatgttccaggattcgaaagaaagcgagacatacgcagagcgtgtggattccgctgacggtgtttatgtcgtgcccgctttcgtcggattgggcacaccgtactgggacagtgacgtgcgcggctcagttttcggcctgacacgcggaacgacgaaggagcattttatccgtgccacgcttgaatctctcgcatatcaggcgaaagatgtgcttgatgccatggaggctgattcaggcatctctttaaaaacattgcgtgtagacggcggagcggtaaaaaataacttcctcatgcagttccagagcgacttgcttgatgtgccggtcgaacgtccggaaattaatgaaacgactgcgctcggtgccgcgtatttagccggaatcgctgtcggctactggaaggacagcactgaaatcgccgatcagtggaaccttgataagcaattcaaaccggaaatggaagatgaaaaacgcgttgaattgtacggcggatggaaaaaagcagtaaatgcagctatggcttttaaataagataaaattatggtatactgaaaacaagttaataggaacggtcctgagatgaggagagaccacagcaccaaagtgatgacatgcgctttggctgttgtggtctctttttctataccgtgacaacaaggaggaagcgtaatgatgaatcaccaattttcaagtttggaacgggatcatatgctggaagacatgactaaaaaacatacgatctgtttattataggcggaggtattacgggtgccggtacggcgcttgacgctgcttcaaggggaatgaaagtcgctttgagcgaaatgcaggatttcgcggccggcacatcaagccgatccacaaagcttgtccacggcggtttgcgttatctgaagcaatttgaagtcaaaatggtggctgaagtcggtaaggaacgcgccatcgtgtacgaaaacggcccgcacgtcacgacgccggaatggatgctgctgccgtttcataaaggcggcacgttcggttcattctctacttcaatcggcctgcgtgtgtatgactatttagcgggagtaaaaaaatcagagcgcagaagcatgctgtctgctaaagaaacgctgcaaaaagagccgctcgtcaaaaaagacggcttaaaaggcggaggctattatgtagagtaccggacggacgatgcgagactgacgattgaagtcatgaaagaagccgttaaattcggtgctgagcctgtcaactattctaaagtgaaagaactgctttatgaaaaaggaaaagttgtcggcgttttaattgaagatctgctgtcaggcaaggaatacaaagtgtacgccaaaaaaatcgtcaatgcgacaggtccgtgggtcgacgaactgagagaaaaagaccacagcaaaagcggaaaacatctccagcacacaaaaggggtccatctcgtattcgaccaatccgtattcccgcttaaacaggcggtgtactttgatacgccggacggccggatggtgttcgccattccgcgtgaaggaaaaacatacgtgggtacgaccgatacggtttacaaacaaaaacttgagcacccgcgcatgacggtgcaggatcgcgattatgtcgtcagctccatcaattatatgttcccggaactgaacattacggcggacgatattgaatcaagctgggccggcctcagaccgcttattcacgaagaagggaaagacccgtctgagatctcccgtaaagatgaaatctggacatctcaatcaggcctgattacgatcgccggaggaaaactgacgggctaccgtaaaatggctgagcacattgtcgatcttgtccgcgaccgcttgaaagaagagggcggccaggacttcggcggctgcaagacgaagacgatgccgatttccggcggacatgtcggcggctctaaaaacttcgagtcatttgtggaagcaaagacaaaagacggcttgaaaatcggtttatcacaggaaaccgctaagcagttagccatcagatacggctctaacgttgaaaatgtattcagccggattgaaggcctgaaagatgaagcggaaaaacgcgagattccggttcacattctggcggaagcggcttacagcatcgaagaagaaatggctgcgacacctgccgatttcttcgtccgcagaacgggaagactgttcttcgacatcaaatgggtgcaaacgtataaaacggccgtgattgattacatgagcgaccgattccaatggaatgacgaaacgaaagaaaaacacactgagtggttaaatacgctgctgcacgacgcggttgttccgctcgaacaataataaccggagggctgtgccgaaaaggcatgagcccttcttttatctttttacataaagcatttggttaagttatcaagtgacacgggcagccgcttcatattaaaatatggtcataagctgaaattataggaggacgaacatgagttggagtaagagttacgaacgctggaatcaggccgaacaattagattcagaattgaaaaaattattggcggacgcagaaggaaacgagcagctgctggaagattttttctacaaaaatcttgagttcggaacaggaggcatgagaggagaaatcgggccgggtacgaacagaatgaacatttacacggtccgcaaagcatccgccggacttgcggcgtatatcgcgaaacagggggaagacgcgaaaaaaagaggggttgcgatcgcatacgactcccgtcataaatctcctgagtttgcgatggaagctgcaaaaacccttgcttcccaaggcattcaaacatacgtctttgatgagctccgcccgacgcctgagctgtcttttgcggtgagaaagctgaacgcttatgccggcatcgtcgtgacggccagccataacccgcctgaatataacggatataaagtgtatggcgatgacggcgcacagctgccgccgaaagaagcggacatcgtcattgcggaagtgaatgccatagaaaatgaattaacgattcaagttgaagatgaacagtcgctgaaagaaaaaggtttgattaaaataatcggtgaagaaattgataaaccgtatactgaaaaactgacttccatctccgtacatcccgagctttcggatgaagtggatgtcagcgtcgtgttcactccgctgcacggcacggcaaataaaccggtgcgccgcggtcttgaagcactcggttacaaaaacgtcaccgtcgtaaaggagcaagagctgccggacccggatttttcaaccgtcaaatcgccgaatccggaagagcacgcggcattcgaatatgccattaagctcggagaagaacaaaatgccgatattctcgtcgctacggacccggatgccgaccgtctcggcattgccgtaaaaaacagcgaaggcaagtacacagtgctgacgggaaaccagacaggcgcgcttttattgcattacctgctttccgagaagaaaaaacagggcacccttcctgaaaacggtgtcgtcatgaaaacgattgtcacgagcgaattgggccgcgctgtcgcttcatcgttcggattagatacggttgacacgctgacaggcttcaaatttatcggtgaaaagatcaaagaatatgaaaaatcaggccaatacacgttccagttcgggtatgaagaaagctacggctacttaatcggcgatttcgcgcgtgacaaagacgcgatccaggctgcgctgttagccgtcgaggtatgcgccttttataaaaagcagggcatgtcgctttatgacgcgctgctgtccatttttaaagaatacggatattaccgtgaaggcttgaagtcattgacgttaaaagggaaacagggagcagagcagatttccgctatcctgacttcattccgaaacgatccgccgaagcagatggccggaaaacaaatcacgcaggctgaagactattcaacgggaaaacggactgtatttgccgatcatcttgaagaagatattgatctgccgaagtcaaatgtcctgaaatatttccttgaagacggctcttggttctgccttcgcccatcaggaacggagccgaaagtgaagttctatttcgccgtgaaggggacttctttacaagacagcgaacagcgtcttgccgcattatctgaagccgtcatgaaaacggtggatggcatagtggaaaaaacgaaataaacaacaaaccgccggaagcgacatccggcggtttttttatacgcctcatccgaaagtatgaggaaaattcatgctgaaaacaaaggaatatacagaaaagaattgatataatatggataattctgattggccggagtgagggaaattgacgaaaacgacggtagaaacgttaaaaacgttaaaagcgattgcggaaaccttaaaccaaaaccacgatttaaaggaagcgcttgataaagtgctccgcgaactgctcagcctgaccggactgcagacagggtggatttttctgattgagccggacgggtcttatacgctcgccgcatccgcttatttaccgcctgctctcggtcagcgggaaaatgcactcatgtgcagcggggaatgctattgtctgaccaaattcagcaatggcggattgacaaaggccgtaaacataatgaattgcaaacggattgaatttgcggaacagacgacgaactgccgcgatacggagggcattacccatcatgcgaccgtaccgcttgaggacggcggccggaagttcggatattgtgcctcacgtgctgacccatatggttcaggatgatcaggataaggaaaaatattatcagctgatcccccgtgaaaaagatgttcttcaagaaatagccaaaggaaaaagcaataaggaaattgcggcggccctgtttatttcagaaaaaacagtgaagacccacgtgtccaacctgctgtcaaagctgaatctttccgatcggacgcaggcggcattgtatgcggtaaaatataatgttttgggaaaggcggtaaaatcatgagcatattagtgatcagcggcacaccgagaaaaaacgggcggacgagaattgccgcttcttatatcagagatcggtttcataccgattttattgatttgagcgaaagtgaactgccgctttataacggtgaagaagaacagaacgagctgccttcagtgcaaaagttaaggcggcaggtgaaaaagtcagcggccgtcgtcttattatctcccgagtatcacagcggcatgagcggcgctttaaaaaacgccatcgattttttaagcagcgatcactgggcatacaaaccggtggccgtcattgccgcggcgggcggaggaaaaggaggcatgaatgcgctggcgaatatgcggacggtcatgcggggcgtctatgcaaatgtcatcccgaaacagctggtcttagacccgattcacatcgacatggagcgccggaccgtatctgaggatatggcggtcagcctgaaagacatgatcgaagagctgaatatgttcacaaacacaagaaatcccggcgtctgacgccgggattgttttatgtcagcatggctaattgatcttcataagcgagctctgtcgcatgatcaatatacccgagaagggaatacagctctttttcaagcacggcatgatcatattcgaaatgatacgcgtgtagaaagtgctcaatacgctttgataataaatcatcttttgtacgaaccatcaaaattaataaattgtcccattgagaccggtgtgtgtaatacaaggctttatcataatcggcatgatccatcttacgcttctcctttcaatgagaagttctccgttagtttatgccgccgaagcccggatgcaacgggggaaaacttggtgtccttatcactgcggcatagcaatatgagggagacataaaataaaaccgcatatccgtctcttctttggacacgctaagattgacaaaaaacgactcaggagaacataaagatgaaatcccttccatttgcgcttgccctcttgttttgcggcattctcattgcctctatcgctgaaaaagggcatacagaacacctcgatccgtcagttgaaaaatgggaacagctcgcatggaaccagcttgaacgtgaatacaagggggccgagcttaccgattattcgtacatgggccgtacaaaagtgaaccgggaacagacgaaagacgtgtttcgcgtaacggtgcaaaccgcaaaagaaacgttttcatcccgtgctgaagtgtatttccatcccgtaacaaaacacgtgatcagcatcaatattttcagactgtaaaaaagctgcacagccttatgcggccgtacagcttatcaggtatcagaagaaacgttttgcgccgaggtagcgctgtttccaataggaattgttcatgctggaaataacgactcccgaatcgttggcattaataaactggccgttcccgagataaataccgacgtgggaaggtccggctttataagttgagaaaaagacaaagtcaccgaccgccggctggctgactgatgtcattgtattccagtagcctgcggctgaaagtctggatacagaagtgaccttattgagaacgtaataaatgaaaccgctgcagtcaaagcctctcggcgtcgttccgccccatacatacggtacgcccagctgagcttttgcggcatcgatcattacattaatcttcgcgcttgttgaacctgtgccgcctgtgctgccggactgattcggtgtcgtgtttgtctgctgcccggtaatcgtcagtttctgtccgatttgaagaacatctgttttcagattgtttttctcgcggatctgctgggctgtcacattgaacttttgggcgatcacccataaagaatccccgcttttcacggtatatgtagtggttttccctgtatttccggactggttcggagctgacggtgaagacgaagagccggaagaagacgttttggtcagcttcagcacttgtccgacccgcagcatgtctgacgtcagtttgttgatgcttctgatttgctgaaccgtcatattgtatgcgtttgcgattttccagagtgagtctccgctttttactgtataggaggacgtttgcgtctggttttgattttggtttgaattgtcttttgacggcgtgtttcccgaagaagacgttccttttgttttcaggacttggtttacgtagatcgtatccgtttttaagttgtttaatactttgagttccgcaatggtcatattgacgctgtttgcgattttccatagtgaatcgccgagttttactttataggtcccggaagatgatgactgctttttgctgctgtttgagctgctgccaggagcggtttttttctgatcggtgcttgaggaaactttccccgtcacttgcagcttctgtccggcgcggattaagtcgcttgtcagaccgttcaattttttcagttcctgtacggacattttaaaatcagatgcgatcagccacagcgagtctccgcttttcactgtatagacgcttttagtcgtgccgctgttctttgaagatggctttttgctgccggaatctgatttgccgttaggaatgttgagcgtctgcccgatagaaagaacggtggattttagatgattcgctgatgtaatggcatccacgcttgtattgtagttttgggcaagcttccataatgaatctccgcttttgaccttaatcgtttgtgcttctgccggtgttacagctaacgcagacccgacgatcgcagatgcagtcaaaccgaccgctaccttttttttcatagtgaatctcccttttcctgcgataatttttctatccccattcgttgcagccgcaaggtgaggatatcagtaatgataatctttatatcggcacttgtctgcaatcgtttatcatattaatagaaatagtccttttttcttatgccggcataaaaaaagaaggaatgcggacattccttcagcttctgagcagtctcataatctcctctttgtttttgaccagatcccttaacgtatatttgtctaaaacggccaggtaagcttgcagggcttcattcagaaggttctttaagttgcaggcgggagatatgatacagagattttttttggagtcaaagcattctacgatgttaaagtcgtcttctgtatgtcgaacgacttctccaatgtttatgtcttccggtgtcattcctaatcgaattccgcctccccggccccggatcgtttcgacatatccgagctggccgagacggtaaatgactttcatgaggtggtttttagagatggaataagtatctgcgatttcttttatgttggaaagttcgtcggaatgtctggaagccaaaaaaatcaaaacgcgtaaagagtaatcggtatagttcgttaatttcatagaatgacctcgaaaaaagagattttgcttctgttacagtctatcatatatgaatctaaaatgaaaaaaaaggaatttgcccccttaactcaaaaaaaacgtgcgctccttctgagcacacgtttttttcgttaagacatcggcggcttacgatcgtcagccgattgatgtttttcaattttgcgatccaattttgcgagataacgggaggcaaattcttttccgccaagaccgaatgaaagtccgaaggcaagcgcgaaaccgcccagaatcagaataaacgcggcatttacgatcgtgtcggcgacaccgagctgatccagcgccataaagattgagagagtgataatggtatatttcgcaagcggcgccaggaatctgaattcctttccgctcagcatgccggcaagcagcctgctgacaagctgtccggccaaaagtccgattccgagaataaatacagcggccagaacattaggcaggtaagcgataataccggttgcgataacgacgagaaattcgagatgaacaagctgcagcgcctctgccgtaaagagcaggacgatgatgatctgaacaatcatgccgaccgtctgagaaagcgtcagcttcggggtgcccgcctgttcaaagcccattttaccgagaagagagtcgaaaccggcccggtgcaggagcccggatacaatgctgctgacccattttccgacccagatgccggcgatgatcagcacaataccgatgatgatattagggagcattgtgaagaccgtgtgcagcatggctgacgccggttcagaaatacccgccacatcaagccggtcaagcgcagagatgatcaccggaatgaaaatcagcacgtagacaatcgttccgatgattgccgacaggctcgtatccttcagataaatagaaagccccatacgtgcggcgagcctttccgttccgatactcgccagaaagtttgtgacgatatcacggacgagacgggcaacaagccagccgattaaaacaatcagcgccgcggcgaataatttcggtataaaggacaaaacgctttgaatcatatttgtaaacggccctgacactccgctgatctggagagcggacaagacgccgggcaggaacaagagcaagacgaagtaaaaaacgattcgtgaagcggccgtaacggatctgctcatctccgcttcttcagacaccattgtccattttctgagccggccgttttcagcgagtttcatgcccgcttttttgacgagatagctgaaaagcgaagcggccgcccagcccacgagcagaatcaagccggcttttaaaacgctcggcacagccgccgttatcgccgacagcatgctgacaaaaggcgaagccacggttgtcagatgcagaatgttaaagaatagaataaaaacgatgattaatgcgataaaataaatgactttactgatgactttttctgaggaatagcgcgccggctttttttcggcgaacagcctgtcgtcgatttttgttttttgcaggcctttgtatacggctttttcaatgattttggcaatgccccagccgataagcaggacgagcagtgcaatgatcagattcgggagtttgctgagatacgtcgtaagcatgtctgctgtattcaagtagaatcgctccttttctttttggggtatggtgtgtgttttacccacttacatataaagcaaacagggcggatgtgccgaaagttttcagtcggaaaccggtctgttatttcatcttttgagaggaggggtcatacattataaataagtccaagtaggggggattcgcttgaacgcggaggagacaaaaggtttacagcgggcaattgaggaaataaccgacattgcaaagggtttcggccttgatttctacccgatgagatatgaaatttgcccggctgaaattatttatacattcggcgcgtacggcatgccgacgagattcagccactggagtttcggcaaacaatttcataagatgaaactccattatgatctcggtttgagcaaaatttatgaacttgtcattaattccaacccttgctacgcttttttgctggacagcaattcgctgatccaaaataaattaattgtagcccatgttcttgcccattgtgattttttcaaaaataactgccgctttcaaaatacgaaccgggacatggttgagagtatggcggctgcggcggagcggattaagcattatgaaagaattcacgggataaaagaggtggagtcctttttagatgccattctggcgattcaggagcatatcgatccgtcgctcgtcaggccgaagctgctgtggagcgtcgatgacgaagaggaggacgaagaagaaaccgcgccatcgccttacgatgatttatggggaatggataagccgaaacaggtgaaaaagaaaagagggaaaaaaccgtttccgccccgtccggaaaaagatattctgctgtttatcgaggaacattcgcgggagcttgaaccgtggcagcgtgacattttaaccatgatgagagaagaaatgctgtatttctggcctcagctggaaacgaaaatcatgaacgaaggctgggcatcctattggcatcagcggattatccgcgagcttgacctgacttcagatgaagccatcgaatttgcgaagctgaacgcaggcgtcgttcagccgtcaaaaacgggaatcaacccgtattatttagggctgaaaatttttgaagacatcgaagagcgttatgacaacccgacagatgaaatgaaaaaaacaggggtaaagcccggttccggccgcgagaaaatgtttgaggtcagggaaattgaatcggacatatcatttatccgcaattatttgacgaaagatctcgttatgcgtgaggatttgtatttattccaaaagcagggcagggactataaagtgatcgacaaagaatggaaggccgtgcgcgaccagctcgtgaacatgcgggtcaacgggggatttccttatctgaccgtcaatgacggggattacctgaagaataatgagctttatattaaacattggtatgagggaattgagcttgatctgaaatatttggagaaagtgctgccgtatctgtaccagctgtggggcaggagcgtgcacatcgaatctgttcttgaagacagagaagtgatgttttcgtatgacggcaaaggagtgcaccggagatatttgtaaaagaagaaaggatgcggggaaatccccgcatccttttttattttccgtgtttcaggatgtgaaagatctttttggcctggtccgtgttgtttaaaagccccgtaaatgactctcttcccggaccgtatgcgtaaacgggaacttcttcgcccgtatgatcgccggttgtccagccgctgtttgttttcgcattaaaaagcttaatgatcgctttgtagacgctcttgtcagcatcctgttttgcggccgtttcgatctgtttaatttccgcttttgaccatttcaggtctgtataacgcgcaagcacggaagatacggatttgcccgctttgatttggtcagccataaatgccggggtttttttggcggcaagaatcggttcaacatgccagtttttatcgtcattcgcgccgatcgtcaatccgccggtggtatgatcagccgtggcaacgacaagcgtatgtttgtcctttttggcaaatgcgatcgctgctttatacgctttttcaaaatccttcatttcactcattgcgccgactatatcattgtcatgtcccgcccagtctatttggcttccttcgaccattaagaagaacccttttttatttttgttcagcctgtcgatcgccgccgttgtcatgtcttctaatgaagggacagcgtttgaccggtcgattgctttgtcgagtccgccatcggcaaacaggccgagaatcttcttgttacggtcctttttcagctcctgttttgatgtcacgtagctgtatcccgcttttttgaaatcctttgttacattgcggtctttacggataaagtttgatttgccgcctccgaggagcacatcgactttttgttttccgttgatgcggtcatcaaagtagctgcttgcgatctcatccatgttctttcgggatttgttatgggctccgaatgccgcaggggtggcgtgggcaatctccgaagttgcgacaagtccggtggatttccctctttgtttcgcttcttcgaggacggatttgacccgctttccttttttatcgactccgatcgccgcgttatacgttttcacgcccgtggccattgccgtgccagccgccgcggaatcggtaatattggaatcaggatcgtcaggataagtcatcatcataccggcgagattggggtcgaatgccgtcagtttcataccatccgaaggctttcctttgttaatgaccgaacggtaggcgttcatatagggtgcgcccattccgtcgccgaccatgaagatgacgtttctgatctcgtttttgtcaggctgtttttttgccgcagcctgttcagagtgctgaaaccccgcgcccgcaatcagaccggctgtcagcacggatacggctgccgccggcagaagttttgatcgaacctgtttaaatagactcattctcactcgtcctcctttaatcgtgtctgcatgtctaatggtagggggtgtttgtaaagagcgcctgttcctcctgtaaatttcaggtgaaacattgttagaaatgtaaattccggtgtaacttatgttttcaagaaagagtgaaaaccattcacttttttgaaaaagacgaggatttttttaacaaggagttatttggaaagtaaactgctttgtttttccaaaatacgaggatcacaggaaaaaaacatgacaaattgactcgtttttcgtcacgtttgaaatcaaattgaaatatttaatacccttaaaaacttttttcaaaaacgaattagtaagaaatttgtcacgggaagtcaagtctatttctagtggaaattgaaccttataataggaaacagataaaaactttaaaaaagagacacataaaatagatagaatcattcagggaggaaaatatgaaaaagcaacttgttacagcaacaacggcagtggttttggggacgactttgtttgcgggcgcggcgtctgcgcaaacgattaaggtaaaaaaaggcgatacattatggggactttcaaatcggtatggaacgtcaattaattccattaaatctgagaacaaattaaaatcggatatcatttacatcggtcagacgctttcgatcaacggtaaatcatcttcaggttcaaattcgggcagcaagtcatcatcgtctacatataaagtcgtaaaaggcgacagcctttggaaaattgcgaataaatataaaatgacggtaaaccaattaaaaagtttaaacggtttaaaaacggacctgatccgcatcggacaagtgcttaaagtaaaaggatcaacttccggttcagcgtcttcaggatcttcgtcatcaaagaagccttcatccagccataatattgcacagacgagcctgaatgtaaacaagctggtttctgatgcgcaatctttaatcggcacgccgtatgtatggggcggaacaacgacttccggctttgactgcagcggatttatctggtacctgttaaacaaacagacgagtgtcggcagaacaagcactgcgggatactggagctcaatgaagagcgtatccagcccgtcaagaggagacttcgtcttctttacaacatatcaagccggtccttcacacatgggtgtatacatcggaaacaacaagttcatccatgccggttctgacggcgtcacaacaagtgatctgaataacagctactggaaaccgcgctacctgggcgcgaaaagattctagcagtgagagaaacccgttcatccgaacgggttttttatttagacggggcagagctccatttgtttcacctaaaaatgaaaatgtgataaaaaatctaaaaaggttttctttttttcattttcatagagggcgatggcgtacgcgcccgcgctcggcatctgggcgaattcgcacggaatttcaatcatgctgcctgcggcgagttcggaccgtaccgctgacagcggcagaaatgagacgcccagcccctctttaataaatcgtttcgtaatatgcgtctgtgtcaccttcattgtcctgacgaaagggaactgtattctgacctggcggagcaaatcatcccaatagtcaggatggttatgggtcaaaagcagatattgtccgaacaggtctttcacttcatccgccttccctgtcccgggttttcggccgggtggcgcgacgaggacaacggggtcattgtacagggggaggcaagtgagggaagatgattgcacctttaagcagctcagtccgatatcggctgagccgtttctgatttgagaggcgatttcttccgattcgaaaatggtgaccgtcatttcggtttctttattgtcctctgtataacgcttcatgacagacgggagaacggtgtcggcgataagcggcgaaacagcgagtgtcagcgtgtgcgagtagccctggcgcaccctgtgcagctccgccatgctgttttcatagtcttccaaaagtctcatggcaaacggcacgtatgcttttccttcttccgtcaattgtattttccggccgctccgctgaaacagcttgcagctgatttctttctctaataattttatatgaacggtgacggtcggctgagataaaaaaagcgtttccgccgtttttctgaaattctcgtattttgccgcggtgacgaaggtgtgaagccatttaaaatccatagatgcactcctctgattaaaagttttaattaattcccttaaaaatattcattattttttaaatattatatttactataataacagaaagaggataagggggaatgaaattgatttatcgtggattgaaagggattacttgtgcagaaacggcgatcagccacattgacggagaaaaggggcatttaatatatcgcggctatgacgcgaaggatatcgcattgcaattcagttttgaagaagcggcgtatctcattttgaacggggcgcttcctgatgagcggcaattgcttgcgtttcaggaagaacttgcagccgagcgcgggcttccgaaacatttgatcggcttactggaaacgcttccggatgaaatggacgacatggcggtgctgagaacggctgtttcaggtttgggcacagattcatttacatatccgcccaagccggaagaagcgattaaactgattgccgtcacaccgacgattattgcgtacagataccgccgtaaacaagggcaggaagcgctgtcacccgaggcgcgatacggacacgttgaaaactatttgtatatgctgacaggcaggcagccgtccgcagcccaaaagaaagcgcttgagacgtatatgattctggcgatggaacacgggatgaatgcatcgactttttcagcgagagtcacggtttcgactgaatcggacttagtgtctgccgtcactgccgcactgggtacgatgaaagggccgctgcacggaggcgcgccttcaggcgtcacgaaaatgcttgaagacatcggggaaaaagaaaatgcagaagcgtatttgacagcgaagcttatgaggggagaacgcctgatgggcttcgggcacagggtgtacaaaacgaaagacccgcgggcggaagcgctgcgcataaaggctgaagaagtggcgggaaatgatccgtcgcttgacttggcgctttatgtggagaaggaagccatccgcttgttagagcaatataagcccggacggaagctgtatacgaatgtggagttttacgcagcggctgtgatgcaggccattgatgtcgacaatgatttatttacgccgaccttttcagcaagcagaatggcaggctggtgcgcacatgtgcttgaacagtccgctgacaacatgatttacagaccgtctgcgaaatacaccggcgcttttcccgaaacggctcagcagctttaattaccggcatatttgtccgtttaactccccgcactgcgtggtatcgtctcagtaataccaattgcaggagtgtgagaatatgaatccgatggacagacagacggaaggacaaaagccgcaggtgcaaaaccgccagcccggcattgagtcagacatggagccaaaaccgctcttggaggatccggatgtaaaagggtcgggcagattaaaaggaaaagtcgccgttattacgggcggagacagcggcatcggcgcagcggctgcgatcgcttacgcgaaggaaggggcggatcttgccatcctgtacctagacgaacatgccgatgccgagagaacgaaaaagcgtgcgagagaataccaggccgattgcctgttaattccgggagacgtcggtgatgaggcgcattgtcagaaggcggtccagcaagtcttagatcactacggaaaaatagatattctcgttaataatgcggctgagcagcatccgcaaaacgggattcttgatattacggctgaacagctggagaagacattccgtacaaacatgttttccatgtttcatatgacaaaagccgtgctgcctcatctcaaaagagggagcgccatcattaatacaacgtcgattaccgcttatcagggagacacatcattgatcgactattcgtgcacgaaaggcggcatcgtttcctttacgcgttcaatggcgatgtcattggccgatcaggggatcagagtaaatgcggtggcacccgggccgatctggaccgccctgattccggcaacgtttactgaagaaaaggtggaaaagcacggtctggacactccgatgggaagaccaggacagcctgcggaacacgcaggagcttatgtgcttctggcttcagacgaatcttcctatatgactgggcagaccattcacgtaaatggaggcaggtttatttcaacataataagcaagtcttatcccgcgcttttaaaaagggcgggatttttatttgattacatatgaatacgatttttaaaaaatagaagccgccagctgaattactaatgttaatatttaacagcggagaatccgctgagttctgttttatgaaaactgaaataatatatagaattttcaaaaaagttattttcatttttatatttttcgctataatatggtgtaggagaaaggaatgatgtgctgaaacatttcatgcgaaaaataagaatttagtcattattgctattgttgtctgaatattctaacatatattgatttacaaggagtgaagcagatgaaggggagcatattcagaaagaaaagcattcaggacctgcttgccgcaacgggcggggaaaagtcgctgaaaagagagttaggggcctttgatttgacacttctggggataggggccatcatcggaacgggaatttttgtattaaccggaacaggcgctgtcacggcggggccggggctgaccgtttcatttgtcatcgccgctcttgcgtgtttatttgcggctttgtcatatgccgaatttgcttcaagcgtcccggtttccggttccgtctacacgtttacttatgcgacactgggtgaacttctcgcatttatcatcggatgggatttaatcttggaatatatgctcgccgtcagcgcggtttcggtcggctggtccggctattttcaatcattcttggcgggcttcggcattcatcttccgaccgcattaacggccgcgccgggatccattaaaggcacggtcacattctttaatctccccgcatttgttatcgtgcttgcgattacattcctcctctacttaggcattaaggaatcgaagcgggtcaataatattatggtcattttgaaggttctggttgttctattgtttatcgccgttgcggccgtatatgtcaaacctcacaactggcagccgtttataccgatggggttcggcggtgttttcagtgccgcggcgctcgttttcttctcttttatcggttttgacgccgtctcttccgccgctgaagaaacgaaaaatccggcgaaggatctgccgaaaggaattatcttttcattaatcgtctgcaccgtgctgtatgtgaccgtatcggcgattatgacgggcgtcgttccgtttgcccgctttgaaggcgttgaccatcccgtgtctctcgtcctgcagatggccggacagaattgggtggccgggattattgatatcggtgcagtgttgggaatgacaacggtgatgctcgtcatgctgtacggccagacgagggtgatgtttgccatgtcccgtgacggtttggtgccgggggcgctttcaaaagtccatccgaagcataaaacgccgcacgtggtgacatgggtgttcggcatcctgtcggcattactcggctcgctcgtcccgcttgatgagctggcgaagctggtgaacatcggcacgcttgccgcgtttgtcctgatttcagtggcggttatcgtattgagaaagaaacagcctgatctgccgagagcttttaaatgtccgggggttccctttattccgatattgtccattctgttctgcgtatttttgattattaaccttggcgccaccaccatattccgtttctttatctggctgatcatcggtctggtgatttatttcttatattcgagaaagcattcgaaattaaacggggatttgtaaggagcggcacccgccgctcctttttatttttcggaataatgaaacatattgaaatgggcttaagttatcgcagtgaataagggataatatagggcggaagggaagtggaaagtcgtgtctgaccaaaaaagggttcaatgggcctcaaaaataggatttattatggccgctgccggttcggcgatcggcctgggagccatttggaagttcccttacgtagcgggtacgaacggaggaggcgctttttttcttgtattcgtcctctttaccgtgcttttaggctatccgcttttgctcggtgaatttattttcggaagacggagccagacaaatgcgattgatgcctacaaacaagccgcgccgaagtcggtatggcacctcacgggttatgtgggtgtggcggcctgttttttagttttgtctttttacagtgttgtcggcgggtggattttgctttatgtgttaaaagctgttacgggttctttatccgggctcactcaggagcagtacggaacggtgttcgggacggtcattgaaaatccgatccagactctcgccgcgcagcttgtatttatgatcttgacagtggcggtcgtcgcaaaaggcgtgcagaaagggattgaacgtgtcagtgcggtgctgatgccggttttattcgtgctgtttctattgctggtgctgcgatcagtcacgctcgatcatgccgttgaggggattagatttttattggttccgcactttgaagatttgacgccggaatccatcctatatgctttaggacaggcgttctttacattaacgctcggcgtttcggtcatggtgacatacagttcgtatctgccgaaaacccaaaaccttccgggatcggcgggttccattgttgtgatgaatgtgctcgtcacgctgtttgcgggactggccatttttccggcggttttttcgttcggatttaaaccggatgaagggcctacactgctgtttaccgtactgccggctgtgtttgaccggctgccgttcggctcgctgttttttatcagctttctggcggtctttttctttgccgcgctgacttcggccttttcgatggtggaaattatcgtagcgactgtcgggaaaggtgatgaaacgaaaaggaagaagctgtcgtggacaagcggtctgctcattttcttagtcggaattccgtcgtgtttatcatacggtgtgctcggtgatgttcatttgttcggaaaaacgttttttgatctagcggatttcacagtgagcaatgtgctgattccgctcggcgctttattaatatcaatcttcatcccgctgaaaataccgaagcgggagctgttcgccgagatgaaaagcggttccgccatcggctatcgtttctttcaggtgtggtatttccttctgaaatacctcgtgccgctggctatcatcgtcgtattgctgcatttaatcggcgttctttcattttaaaaaaacaggcccctgtaaaagggcctgtttttatgtttaaaaaccgaattgcagattcgtatcaacggcaacgatcgtatatacacaaacaatgacgaaaaggttgaggatgacaccgagcagtcccgggcccgtccgtccttttttaataaacagctcaatgatgccgaacggcacggcggccatcgcaaacggcagcatctgataagaatagaaagtcacattgctgatgattgccacgttcaaaagcagcagcgacaaaatcgcggtaccgactgatatccagccgaaaacattatgctctttaaaaattcttaccaattccataattccacctcaccgatgtttgctgcttttactgttttatttttcagcagacgttcgatttcttttgtcggccccgtcacgacagagccgtatacgttcattccgtgatgttcaacatagtcgattcggctgccaagattcatgtctttgcgtttcgatattgcatgcgcccattttttatggcgggacataaattcaagggcattgataaattgttcacggtctgtctgtccttgcgtttcgaaagaggacaccatcttggaatctttcccgggaaatcctaacggctcggcataaggactgtctttcagatttttctccgtttcgaccgcgttccataaaaacttcacatcgtattttttaaaagtagaatatacttgagaagaaggataggcccggtcataagaaagatagacctccgccacgcttccttcaggcaatttttttaatgtctgtccggctttgtcaatcgtgcgttcctttaagccggaaggatgggcaaaataatgctttgcctgtgccgcgtctagatcatagtagttaacggcaggcgatttgaccgtatctaaaaacatttcaatccgttctccgccgacggatttcgtttttgtgccgatctgcttttgcagcggaaactctgtattcatcccaaacagcttcacctggcttttcagtccggaggtatcgacgagtacgttcggcatggtggtcgccaccgtcacggctgcggtttccattaattgattgccggtgctttcttttcctcccaaaccgtaatagaggtagcttcccaaagtgcaaagcggcaaaatcatcaaggtggagatgacggcgagaactgaaatccgcaaatacgatttgcgttttccgtatgacaaaatggccttctgtttttccgggctgatgccgacgtcccattcccggtcgtcctgcatttcgctttcaatcaactcctgatagacttcaagcttttccagctcttcttcaaaggcggccatttcccggtcgctcatttctccatttttgtattggtaaaaacgctttttaaattcttcattcatcattaacacctctattataaagtgctttcagccgctgtctggcacgaaataaaacacttttaaaattagcctctgaaatattcataatatgggatgcttctttgtaattcagttcttttaaataatacagtgttaaggcctcccgataattgtcgggaagttcggacatataccctgtcagcacttccttgatttcaatctgatgagccgggctttgaacagccgtctgaaaaaggctcccaattaagtcatcggaaatggtcacttcctttttatgttttctgacataatctataaacgcatttctcgccacttgaaaaagccatggctttactttgctgtggtcgtaggagtgaatgtgtatgtatgccctcataaaggtttcctgcagcaaatcttcagcgagatgcttgtcttttgtcatggagagcaggaaccggtaaacatcattcatatacatttggtaaatttcatcgatcgtcactgccttttctcccctctatgttatacacgcataagaaaggtttaaagttgcacgttccatgcaaacggcttaaattcattttcacctcatcaaacaccatttctctatagtacccaaaatccgtcataaaagatagagatcggcggaggaaaaatatatttattagtaccaggtaataaaaaatattgttataatagagagagaacacttttgatcattacaacaaaggaagtgcgttatgtataagttttgtgcaaatgccatcaaattcattctttctctgcgcggaggagtcaaagtatacaataaagagaatcttccgtctgataaaggattcgttatcgcgtgcacgcatgcgggctgggtggacgtcctcacgctcggtgtcgggatattgccccatcagattcattatatggcgaaaaaagagctgtttcagaaaaagtggatcggaagttttttaaagaagattcacgcgtttccggttgatcgtgaaaatccgggtccgagcagcattaaaacgccgattaagcttctgaaggaagggaagattgtagggatttttccgagcggcacgagaacttctgaagacgtcccgctgaaaagaggggccgtgaccatcgcccaaatggggaaagcgccgctcgttccggccgcatataaagggccgtctacgggaaaagcgctgtttaaaaagggaaaaatgcggcttatcatcggcgagccgatttttttggaggacttttccgatcttgcgccgaaggagaggcttgcggccatgacagaagagctgaatgccagaattaaagagcttgagaaaaaacttgaacaactgtaaatgaaaaaaagcttgccgtctgtatcagacgcgcaagcttttttgttatgcttctttttgttcggcagtttccagcagttcatcaaacgccagttttttcacttcgatatatgcgacgtggtggccgtcaatttcattaatgataaattcgcagccttcttcgataatcgagtcgtattgttcgacgtcgtatttctgggtaaggaaccagccgccgatggtgtcgacctcgtcattttccaaatggatgccgaggagttcgttcacttgatcaatcaggaccttgccgtcaagcatgtaatggccgtcgccgagtttgcggatttcattgatttcatcgatatcaaattcatcacggatttccccgacgatttcttcaataatgtcttcaacggtgacaagccccgcggttccgccgtattcatccgacagaatcgccatatgaacccgttccttctgcatttttacaagcagatcgtgaatcggtgccgactcaatcacatggatgatcggattgacaaaatccgtaatcggcgagtcgactgatacttcgccgctgatgcaggcggtcagcacttctttaatgttaataacgccgataatattatctttgtcaccctcttcgacagggtaccgggtatatttttcaatctgaatgatatccatcatttcagaaattttgatatcatgcggcagactgacgatttccgtacgcggaatcatgatttcttttgcaagtctgtcgtcaaattcaaagattttgttcacatatttaaattcagactggttgatttcaccgcttttatagctttccgataaaatgatgcgcagctcttcttcagagtgggcaagctcattttcagacaccgtctccagaccgaacgtcttcgttaaaagacgggcggagttgttcagaagccagataaacgggaacatgatgcggtaaaaccaaatgagcggtttcgaaaacagcattgaaacggcttccgctttctggatggcgactgttttcggcgccaattctcccacgaccacgtgtaagaatgtaatgatcgcgtaggcgagaataaatgaaataatatgcgataatgagcttggtacgtttatctttgtgaaaagcgggtgaagcaagcgttcaatcgttgattcgcctaagacaccaagaccgatggaagtcaatgttatgccgagctggcacgccgataaatactcatctaaatgcgtggtcacttttttgacaccgattgcggctttatttccttctgctataagctggtcaacccgtgagcctctgattctgattatcgcaaactcagatgctacgaaaaatgccgtcagcgcgattaaaaccgcgactaaaatcaaattcacaatgtccaattagaaccttcactccttttgggaagatgaaggtaacacctcctgttagtaagataatggtttaacttaacagcagcataaatgattgaagcactgcaagcttttcaggagccagcctttttttcagctgggcgcgctcctctggttcaagcttttcaaaccgattcaagatcccggagatgttttgattcatgtgatcaatttccgatgccagatttccaacatcgtcaggcagggctgaagagggaaactggttctccagtcgatcttttatatcagacagggccaatcgctgctttttacaagcgactataaactttaaccgattaagtgcaagtgtatcgtagtaacgatagttcgaacaagacctgtcaggctttaaaagcccgaggtttgtgtagtaatccaccgtgcgtttcgttacaccggcaagctctgctaattcactgatgcgataagtctcagccccatctaaatccctccccaaccatcacgttatagttatgagaatagtttaatatatgaaggggagtttgcacaagtttattgttttccgtctttctcctgaaacggggcggcaggctgtctgaaaaagcgttgactgcgccatgtaaatctttcataatcattgtaaatagaaacggcagaaaaagacagaagggacagatgacagtggccggtttatcaagggaagtgacacagaacctggagaaaggttcatggatacgcaaactatttgatgaaggcgctcggctgaaaaaagagttcggcgccgataaggtgtttgacttttcaataggaaatccggttgcggagccgcctgaaacgtttaaaaaggcgctttgcgaagcggctgaaacagggcggcacggatacatacaaaaccaagggcttccggaggcgagagaaaaggttgcccgctttttgtcagagcggtttcagaccgagatttccgccaggcatacagttatgacggtcggagccggcggggcgctgaatgtcgcgctgaagagcattttaaacccggaggaagaagtcatccttctttcgccttattttgcggaatataaagcgtatgttgaaaattaccgcggcagacccgtcatctgcccgctgactgactcatttgagattgatattgaagcggttaaaggtgcgatcacaccccgtacgaaaggactgatcgttaatacgccgcataatccgacggggactgtgctcagccagaaaaaccttaacgaattaggcgccttattaaaagaagccgaagagcggaacggccaaagcatatttattttatttgatgaaccgtacagccagctgatctacggagaagagcaggcgaatccgtttcaggcgtatcaccgcgtgattttagtcagttcgttcagtaaagatctcggcattgcgggggaaaggctcgggtatatcgcggcggacgcccaaatgcctgagggcgatcttctgacggatgcgttcgttttctgcaaccggacgctcggctttgtgaacgctccggtcatgatgcagcgcgccgtggcgaaaatggatgatctttcgattgacgctgaaccttacagaaagcggagagaccttatggtggacatcctcacagaagccggcttcgaatttgaaatgccgaaaggaggctttttcgtctttccgaaatcaccgattgaagacgaggtggcgttctgtatgcatgccgcacagaaatacagactattgatcgtacccggcagcggatttggaaaaagcggctatttccgattatctttcagcgtgccttcggaacagatcagacagtcgcgcgatattttcaaagcactgtatcaagatttttcttcatagcttccaacacataaagatgggagaacggacaaatgtcgaggagaaataatggcacatcagacatcagcattacaggaatcggagtcttaaccgcggtcggacaaggcaaggaggcgtttctcgatgcgctcatggaggggcggcacgcctttgatgtgatgaaacgtcccggccggcagaaaggcagttcgtttatcggcgcggagcttagcgaattaacgccgccggacgcgctgtcgaagcgcttgtaccgaagggccgcattatcaggaaagacggcgcttatcgctttatatgaagcgtggcatgacgctcaattagacggcgctgatcacagccgcaccggtctgatcatcggcgggtcgaatatgacgcagcgcgaattgctgcaggcctttgagaaaaacggtgaaacgccgcaatttgtaaatccgacatacgggctttcttttatggatagtgatttgtcggggctttgcacggagcaattcgggataaaagggccggcctttacggtcggcggcgcgtcggcaagcggccaggcggcggttatccaggctgctcaaggaattaaaggaggcctgtttgaccggtgcatcgtgatcggggcgctggccgatctgtcgtacatggagtgtcacgctctccgttctttgggagcgatgggcactgatacatacgctgaacggcctgaagccgcctgccgcccgtttgaccggcatacggacgggtttatattcggagaggcgtgcggggcgattgtgctggagcgcgctgaatctgccgaagagaggggcgcacgatcgtgggccggcttaaagggctgggggatggcttccgatgcgaaccgcaacccgaatccttcagcagagggcgaaatgacggtgatccgccaggcgctggagcgggccggtctttcagcgaaagagatcgattacatcaacccgcacggcaccggttcgccgatcggagataagactgaatgccgggcgctttctgaaagcggcctgtcgcacgcgcggattaatgcgacaaaatcgattaccggacacggtctgagtgcggccggaacggtggaaatcattgctgttctcttgcaaatgcgggaaaacaagcttcatccgatccgaaacttaacggagccgattgacgattcatttcagtgggtgaccgacgggccgagcgcccataccgtacaccatgcgttaagcttaagcatgggattcgggggattaatacggcgctttgtttagaaaatcatttccgaagcagataacggcagccttctttttgaaggctgtttttatatgatgaaaaatctgaaaatgatgaaagaatggagttgtgatacaataaactatacaaatgacaatcatgctttgacttaggaggtggcaggatggggccctctgtgtagtcaatcacccatttcgttcctctcgcttaagaaaaaacgatgaaatcaggaggtgacgtccttatccttcaattcgggataaggtgaaatggacgatattgacagtttgattttaatcggtgtgctcattgcgttaacggcatttttcgtggcgagtgaatttgcgatcgtcagagtgaggagatccagaatcgatcagctcatctcagaaggaaacagacgggcggtgctcgcaaagcgtatcattacggatcttgatgagtatttatccgcctcgcagcttggcattacactcacatccatcgggctcggcgtactgggagagcctgcatttgagcggatgcttcatcctgtgtttcagggtatggggctgccggattctgccgagcatgtgattgcttttgctgcggcgtacgggctgattacgtttttacatgtcgtcgtcggtgagcttgcgcctaaaacggttgcgattcaaaaagcggaaaagctgacgttatggattgccggaccgcttcggttattttacgtgttcatgttcccgtttatttgggtgctgaacggctccgcgagaattctgaccggtttggccggattaaagccggcatctgagcatgaaggctcccactctgaagaagagctgcggatcctgctgtcagaaagtttaaaaaacggagaaatcaatccgtctgaatatacatttgtgaataaaatttttgattttgataatcggatcgccaaggaaatcatgatcccgagaaaagaaatcgcggctgtttccactgatatggacgtgccggaaatgcttgatatgatgctgaaagacaaatatacgcgctggcccgtaacggacggggacaaagacagtgtcatcggcatgatcaatacgaagcatctcttttcagatctgctgtttatgacagaagatgaaaaagcggaagtatccatcatgtcttacgtccgcccggtgattgaagtcatcgagacgatcccgatacacgacctgctgataaaaatgcagagagaacggattcatttggcgatattgtctgatgaatacggcggaacgtccggtcttgtgacgaccgaagacatacttgaagaaatcgtcggcgatatcagagacgaatttgatgaggacgaacagccgcagattcaaaagctgtccgaacgccattatgtgctggacggaaaggttcggatcgatcaggtgaatcatcttctcggcgcagagattgaagaggaagtcgacacgatcggcggtcttgtgctgaaacggaatattgacatttgtgcgggtgagtcgatacaaatcgggggatacactgccctcatattagaaatggacggccggtttattaaacagcttgaactcaaagaagaacagggccgcccgggcggtcaggggacaataaaccgcccgctgcccgtgccggaaacggtcatgcttcataacgcaaccttgagcgaaaaataagctcaaggtttttttaaatggatatcataacaaagccgcaccagaacgccaaaaggcttccggctgctgaaacagcgatgtagagcaggctttcctttatgcggttgttcatcatcagctgcacggcttcaatactgaaggtggaaaaggtcgtaaacgcaccgaaaaagcccgtcgcgatgatgacgccggcagaaggattatccagacccaagccggtgaatatgccgaggctgaaggagccgagcaggttgaccgcagccattccaagcggaatcggaaaaccttttgttctttctgaaattgtcttacccagcagagaccgtaataccgctccgatacccgccgcgataagcatcaggacaatcgtcatggcgtatcatgcccccttccggctgcgtgaagggcaatccgccgtcccaaaaaaatgccggcgtatgcaagagcaagaccagcgaataaagtcgcggcagcataacaaaaagccgctgcgggagacgattgcagcagaaaaatggtttcttttgcgaaggttgacatcgtcgtgaaacctccgcaaaaaccggttcctaaaaaggcggtcaaaagagggcgtttagcccgaatgatgaaataacccgtaataagaccgagtaaaaggcttcccgccgcgttttcgaggaaagtggcacccgggaaagttccgctgtgaatgtgcgcgctcatttcaaagcggagcaatgcgccaagcgcgcctccgataaaaattgcgatgtattgtttcatatcagccatccttagaaataatatccggaaaatcagttacaatgccgtcaactgccatcatttgcagcttttcggccgtcttgtgatttctgaccgtccaggcaaatactttcaggccgtgtttgtgagcggtggaaatcaagaaccgattcaggcgggtatatttaatattgacataatttgcggctgatttgtaagcggccagctggcttttggaaaacatcccgaagctgggtcttgcgataattgcagtcggaacggacggatacatgtcgtgaaaggtctgaatcgacttgagactgaatgattgaacgatagggtgaatggaaaaggtaaacctgcttaacagctggccgactgctttttcaagaccgacttgagaaacgtgccctttcagttcaattaaaaatccgatttcagaatgataacgcttcagaacctcttcgagcaggggaatccgctcccctttaaactcagccccataccagctgccggcgtccagagactgcagcttcttcagcgtaaaatcttttacaaaaccggagccgtccgtcgtccggtcgactttgtcatcatggatgacgacaatctggccgtcttttgtgagctggacgtcaagctcaatgaaatcagcgttcatttcggcagcgatatcaaatgccgcaaatgtattttcgggcgcgtaaccggatgcgccgcgatgagcgatggtatacaagcttgtcagctcccctcatgggcatttctgttattatatcagattcgtatatgcacagcgattcaaactggtgaatgtgcaaaacagtatttttttggaataaagatagtgcttttttcggtttacaatccgcagtgatgatttataatggcaaaaaggaggcgagatcatgggaaaagggagattgaaagtggaagaaagaattaaggccgaaaccgatgctgaaatccaaaaagcgactctcctgaaacagacacaatcaaagaagaaatagtgcctgaccctgttgtatctggctgaaagatgaacgaatgtgtgaaaaaccccggctgtgctctgaggccggggtttttcaggctgcctaaagacattaaaacaagctgatgtccgaatgttttagtataatagattttcgacaagacaaaggagcatatgccatgatgacacaatttcagagcttttttactcttgaccatattttgcagatcagtatcagcatcggaattttagcggcttttctcgttttgagaaaactgtttgtcaaatacttttttcagctcatttacaaattggcgaacaagccgaaaaccgacatattcaaacagattgccgtagcgtttgacaagccggccagatggtttttcgtggcgctgggtctgtttttggcgattgagtattcgccgtttttagacgggcagatggacattgtcaaaaaaatgtaccgctctttgatcatagcgctgatcgcctgggggctttgcaatctgacatcggcgtcttcgtttttatttcataaagtcaatcagcgctttgagcttgatatggatgacattttggcgccgtttttatccaaggtgctgcgctttgtcattctcgcgctcagcgtcagtgtgatcgcgcaggaattcaattatgatgtaaacgggttcgtggccggactcggacttggcggcttggccttcgcgcttgcggctaaagatacgatcagcaattttttcggcggcattatcatcattacggaaaagccgtttacgatcggcgactgggtcgagacgtcatctgtgacggggggcgttgaagatatcacattccgaagcacaaggttccgcacggcgcagggggcgcttgttaccgtacccaattcaacgctgtccatggaagccatcacaaactggacgaggatgacgaagcgccaggtcacgttttccgttcgtgtttcttatgcgacgccgattgatcgtttagagcggtgcatcacaaggctcagggaaatgcttcgtgaacatgaaggcgtgcatgatgatacgattatggttaactttgacgtgtttgcggacagctattacaatctgtttttcaacttttacacaaagaccatcgtctgggcggaaagcctggacgtgcggcaggatatcaaccgccggattattgatatttttgctgaggaaggcgtggagttcgcctatccgggccagaatgtattcgtaaaacagaagagccacgatgatccggttcatgtgaaggatcattccggagaaaaagaacgggcataacaggcgccgttcttttttcatgatatgataaaaagaaaaggcggtggaagagtggaagcgtttataacattgatcaatcaggctgaacgtatcctggtgctgacgggagcgggaatgagcacggaatccggcattcccgattttcgttcggcgggcggtatatggaccgaagacacctccagaatggaagcgatgagcagggaatactttgaacgccgtccgcgtgaattctggcctaaattcaaacagctctttcagatgaaaatgagcggaagctatgagccgaatgccggccatacgtatttggcggatcttgaaaagcggggaaagcaggtagacattttcacgcagaacattgacggactgcataagaaagcgggaagcagcagtgtctatgagcttcacggttcaattcagaccgccgcatgcccccgctgcggagcgcgctacgggctttctcatctgctgaaggacgaagtgccggaatgtacggccgaagtcggtgatcatgcggtatgcggcaccgtattaaagacggatgtcgtgctgttcggcgatctcgttcagcattttgaaaccctttatgaaaagcttgataaagctgatcttcttcttgtgatcggcacttcgcttgaagtggcgccggcaaggtttgtccctgaggatgcgggccggattcccggtttgaagcaagtgatcattaaccttgagccgacatattgcgaccatttatttgatcttgtcatccatgagaagatcggtgaatttgcaaaacggatcagcgccgcgacataaaaaaagccggatcctatacagatccggcttttcttattcatggacgggaatcatttgatccgtcagaacatcaaaggagtagccctgggctttcagtttttggatcaggctcggtaaagcgtgcaccgtcgcaggcagatcgtgcattaaaatgacatgcggcctgctcgtatgaacgctttccaaatatgcgagctgattcaatacttccggcacgtaccgcgcgtttttgtacttccagtcttcactgtctatcgtccagtcccagtacacgaatccgtctttttcgagattcttaatctgggcatccgtcaatgagggtttactgccgtaaggcgtgcggacaagatccgtttttactccagtgattgtctcgagcgtatcgcgtccctgctgcatttcgttcagcggtgatgtcggtgtttgataaaacaggtgattatcgtgcgtcacgccgtgcaggcccagcgcgatcccttcctgcttcgctctttgcacggaatgcttataggctttcatccgcggttcaagcataaaaaaagtggcctttgcgccatttgccttcaatacattcaacagctgttcagtatatggagacggcccgtcgtcgaaggttaaatataccgtttttttccctgggtcacgctctttctgcaaatgtttcattaagacgtcgggagaatcatttttcagccgcaggctttctgcttcatcccgaagctgcccgtttgcggtcacggtgacctgtttgttttttgcggcggaagcggaatatcccattatgacgattaccagaagcagtccgcacaaaactgctaaactcgtaagtttaaaagccaatgaaaacagagaaggggaagcaccttcttttgtgttgcgcataacaatctctccagtagcataagtttctgcataatgccgataacagcggaggcttgcgaagtgccataagttaacagcatatgtatgtcgaatcaagtatacaggaacaaaactggaaaagacatagaaaagatgtcgaataataagattttaagaaaaaaataaactccgcagccggctcgttcagtatgatagaatagttgacaataacagctgagaatgcacatcacggcagataacgattaggagggtttacatgaagacattagtaaacggccagttgattgatcgtgaagaagcggcagttgatattgaggaccgcggatatcaattcggtgacggtgtgtatgaggtcatcagagtgtataacggcgccttattcggtctgcgtgagcatatcgcccgtcttttcagaagcgccgcagaaatcggcatcaccctgccgttctccgcagaggacatagaatgggatctgcaaaagctcgtacaggaaaacaaactcattgacggcggggtctatatacagacgacgagagggaaggcgccgcggaagcaccagtatgacgaaggattggagccgcagacgacggcatacaccttttcagtgaaaaaaccggaaaatgaacaaaaagccggagcgcaggccatcacggcggaagacaaacgctggctgaggtgtgacattaagagtctgaatttactgtataatgtgatgataaaacaaaaagcctatgaagcaggcgcttatgaagccgtgctgataagggacggggcggtcacggaaggaacctcatccaatgtatacgccgtcataaacggcaccgtccggacgcatcctgcaaatgagctgattttaaacggcattacgcggatgaaactgttagagctgatgaaagaaaacgggattgaggtgcgggagaaggctcttaccgaagaggaactcagagatgcggatgaaattttcatctcgtcaaccacgtctgaattaatcccgatcgtaacccttgacggaaaaccggtcggaagcggatcgccgggacctgtagccaaaacgattcaggaggcttttcagtcgcacattcagcaggagctcggcgttcagtcataagctgaaaaaaaggccggaacacatccggcctttttgctccagtcagataaaaagagattcgatatgctgaacgagtacacgggagatcttctcttttgaaagacgatcaggttcaagcatggcatgcagcgccaatccgtcggcgatagcgtacattttctccgcttcggtttctttatcaagattcggtttcagaagcttattttcatccagccagtcaatcaggccgcggatatatgccaagatcccgtcctgctggggttgaaactcttctcccttatgtctggcataagctgtgaaagcgaaccacacctccatttcagccatcgtttcttcatctgtcgggataatttcaagcatcagacgcaccgctttttctttcggcggcagatctttcatggcaacttcgttaattctggcggccgctttttcttttacgagtgtcatcgcataccctaaaagctcatcctgggtggtgaaatagtgcctcagcgcgcctaaagaaagacccgcttcttgggcgatgtttctcactgtcgctccttccattccccgctccaaaatcgtccgccaagtggcttcggctatttgttttcttcttttttcatgatcgattattttaggcatggttccagtgtaacaggaaatattttttcttgcaattttgtaatacagttgtattaaataaaaagcagtgatacaatgcattttagaaaacgataagggggaaccggattgaacgcgattgcttggttgattgtcatttgtgaggctgctttttgggcggctgtcatcttcggattggcggcgcgctatatattcaggcggcaaaagctcggaatgttttttttcgctctcattcctatattggatgccgtactgtttctggcggccgcagctgatttatacagaggggcggcggcgactatggcgcatgcagtggcggccgtttatatcggagtgtctgtcgccttcggaaaaagcatgattcagtgggcggatgagcggttccgctattatgtggtaaaggaaggggcaaaaccggtcaagcggtacggactggattatgccaaacattatgcaaaaggatggggaagacatgtattagcatttgtcatcggcggcgttcttttagccggaacggtatttctcattcaggacgcttcccgcaccgaagcgctcagcggactgttaaagggctggtctgtcgtattgtgcatcgattttttgatcatggcgagtttttttgtaatgccgaaaaaaagaaaaaacagccgggagctgtaaaaaaagcagcttttgattaagctgctttacagaaagaattattttacgatcagcacgggaatatcggatttcgatgacagtttttcactgacgcttccgaataaaagttttttcagcctgttctggtcccggctccccatgacgatcaaatccgccgatatacggtcggcatgctcgataatggcatcagcgggatcaccttctaaaatgtcgatatccccgtcaatctggctgtcgttcatcagcattctcgcttccgcaacgatttcttccgtacggtcttcataaatcatcggatcaggggagattctttccgcctgaagcgggtcaggaacgcttgcaatcccgccgccgatatacgttgccccggctcccggcctcgggggatcaacaatcgtctgggtatcttttgcactgtgggaatgtacgaccgttaaatccgcgtggaacgtttttgaaaggtctatggctttttgaagcgcttttttactatcatcacttccgtcaaaagctgctatcaaccggtctgcgtgaaacatcagcctcatcctttcagtaaaaaaggtttgttttacaatacccgtgcggcagaaatgtaaaacccgcattgacaaaaaaaggatttatttatatgatgaaggaacaatataggaaaaaggaggtatggatcatgtcaaaactaaagcttgtcaactcatcttcagctgaataccggcgtgacttccatacagcttccgttttctgaacatttgcttaaaaacggggcagtcgcgcataaacggcgggtctgtaccttatttataataataagaggcatggagctgaggcttcatgtctttttttatacaaaaaaatgaaagaaagacaggtgtgatgcatgtggcggcattagcgaaaacaatgaaaaacaatccggaaaagcttgagggcggctgattgatgaaaggggatgacggtatttgtttactgtattaaaaaagctcgcgtggttttttaaagcctattggctgcgctatacgacagcgattgttctgttattgattgtgaatgtcattgagatgtttccgcctaaacttctcggtaatgcgatagacgatatgaaggcgggcgtgtttacgaaaagcgggatgctgttttacatatgtgtttttctcgcattaacggcagccgtctatttactgtcttatttttggatgtatcagcttttcggcggggcgaatgtcatggagaaaattctccggtcaaagctgatgggaaggcttcttcaaatgtcaccgccgttttacgagaaatacagaacgggcgatttaatggcgcgggggacaaatgacctgcaggccgtcagtatgacgacgggcttcggggtcttaacgctcgttgattcgacgatgtatatgctgacgatatttttgacaatggggcttctcatcagctggaagctgacatttgccgcgattattccgctgccgataatggcggctgcggtcagcctgtacggaaaaaagatccatgagcggtttacggaagcgcaggatgctttcggatcattaaatgacaaggtgctggagtcggtatccggcgtccgggtcatccgggcatttgtgcaggaaaaaaatgatgtcagccggttcggtgatatgacggcggatgtatatgagaaaaatatgaaggtggcgtttatcgattcactttttgaaccgactgtgaaacttctcgtcggcctcagctatctcataggtctcggctacggcgcttatctcgtttttcaaaaccggctgacgctgggagagctggtatcgtttaacgtgtacctcggaatgatgatctggccgatgtttgcgatcggagaattaatcaatatcatgcagcgcggcaatgcctccttggatcgtgtcaatgagacgctttcctatgagcctgacgtgatcgggcccaagcgccccgccggcatcaaggagcccgggcgtcttgtttttgaacaagtgactttcacgtatccgagcggagcgggaccggcggtttccgatgtatctttttccgtagaaaaagggcagacactcggcatcgtcgggaagacgggaagcggaaagacgacgatcattaagcagctgctgcgtgaatatccgcccggtgcgggagaggtcacgtttacaggcgtcccgattcaggagatcccgcttgaggagctccgcgggtggatcggctatgtgccgcaggatcatattttattttctaagactgtaaaggagaatctgctttacggacggcaggatgcaaacgaagaggaaatcggcggcgcgctgaaagatgcgcattttgaaaacgatatcggcatgctttccgacgggcttgagacgcttgtcggcgagaagggcgtagcgctctcgggcggacaaaagcagcgcatctcaattgcgagagcgcttttgaccgatcctgatattctcatattagatgattcgctttctgccgtagacgcgaaaacggaagccgccatcattgacagcatccgtaaaaaacggcggcataaaacaacgattatcaccacccaccggctctcggcagttgaacacgcagatctcattctcgtcatggacgaaggccgggtgtctgaaagaggcacgcaccgggagctattggcgcagaacggctggtatcgaaaacaatatgagaggcagcagctgtcctctcttgaagaaggggggacgggcgcatgaagaccgggagaagattatggaattacgcgcttcaatataagaagctgctgatatgggcggtcgtcctgctcattattgcggtcggcactgagctgaccggcccgtttatcggaaaaaaaatgattgatgaccacattctcggcattgaaaaaacatgggttaaagcctctgcggacgatccgggcgccgtcaggttccgggggcatgattatgtcagggaggaccggctcaaaccgggggcggataaaaccggagaggcgcacatttatcaagtcggtgcgggctactattttgttgaccgtcccgtcagttttgacggaaaccgttcggtgtctgacggccggctgacaatatcaaacggtaaagaaagcaggtcatatcccgtcattacgttatcaagacaggagatttttgaattttaccgtccggaaataaaaggattgctgacgttgaccgccatttatgcgggattgctcatgttttccgtatgttttcattacggtcagcattatctgctgcagatgggagcgaaccggatcatacagcgcatgaggcaggatgtattttcacacattcagaaaatgccgatccgctactttgataatctgcctgccggaaaagtcgtggcccgtattacgaatgacacagaagcggtgagggatttatatgtaacggtgctgtcgacatttatcacaagcggcgtttatatgctcggcatttttacggcgctgtttatgcttgacgtcaggctggccgccgtttgccttctgattattccgattttaatgatctggtcggttgtgtaccgcaaatatgcatccgtcttcaatcaaaaaatccgttccattaacagtgacatcaatgcgaaaatgaacgagtccattcaaggaatgccgattattcaggcgttccgccgcgagaaggaaacgatgaaggaatttgaagaattgaatgaagctcatttccgctacaaaaacaaaatgctgtccttaaattccctcatgtcccacagtcttgtcaatgtgttgcgcaatctggcgtttgtcgggctgatctggtatttcggaggcgcgagtctgagtgcggccggaattgtttcgatcggtgttttatatgcatttgttgattatttaaaccgtttgttccagccggttacggggattgtcaaccaattttcgaagcttgaattggcccgtgtctctgccgccagagtattcgagcttttacaggaggaggaaacggaagaagaaggcgctcccgcagacagaaaggcggaagggacagtggaattccgcgatgtttcttttggatatcgaaagggagaagaggtgctgaaacacatcagctttacagctgaaaaaggggagacggtcgccctcgtcggccatacggggtccggcaaaagctccatcctgaatcttctgttccgtttttatgatgcccaaaaaggggatatcctgctggacggtaaaagcatatacagcatgtcaaggcaggagctgaggtcgcatatgggcattgtgctgcaagacccgtatcttttctcgggcacgatcggctccaatgtgacactcgatgatcagcgtatttctctggagcaggcggaagaagcgcttcgccaagtcggcgccgcaagccttctgcaatctttgccgaagggcatcagagagcccgtcaccgaaaaaggcggcacactgtcctcaggccagcgtcagctgatttcttttgcaagagcgcttgtgttcgatccggccattttaattttggatgaggcgacggcgcacattgacaccgaaacagaagcggtcattcaaaaagcgctgcaagtggttcaagaagggcgcacgacatttattatcgcccatcggctttccacgatcagacacgcagaccagattctcgtgctggaaaagggccgcatcattgaaaagggaagccatgacgaattaatggcgcaaaaggggcagtaccatcaaatgtatgaattacagaaaggaacggcgaaatccgcggtgtaatcggaaagggtgaatcaaaagattcgcccttttttcattcagtaagccagtcctacccgttttctgacaaactgcgggctgatcagctcgcggtacagaaaatgtgccgtgtctccgactgtgatttcggcgccgtcttcaggaaggcgatcctgttcgaaccggtaaactccggcagcgtctccgtcaggaaggtaggtagggcagatgatcgtccagtcaagatcctctgccagcagcatctcgtatacgcgggcgtgttcctttgcggctcttgttgattttcgttttgattctgccgattcaaaacggtattgatcaggcataagccgtgattgaaggatacccgcggtgccgatcgtaatcagacgctgaacatgatgccgtttcatgccgtctattatatgggtcatagcggctgaaagggtatcgtcaccgtccgtgccgagacagctcacgactgtgtccgctttggaaatcaatcggctgacatcttcccgccgcctcgcattccctgttatgatctgtttttcaggaatgggaaggactgttccggctgatctgacaagagcgaatatttccatgtgtccatgtttctgcgcttcttttataaaagcctgtccgactcttcccgttgctccgagtaaagcgatgttcatgtaaaaaacctcctcgccgctcattatatcattcaaagcagcggggaaaagaatgcctgtgaataaacgggaaatggtgggcaacatattcattgaccaaagaaacacttacgaactgaaacagctcccaattgactgaggcaatgaatgacatgttttccctccttttttcctagggtatgtggaataggaaaaaagggtgacggcataaaagaagacgcggtatcccgcgccttctgtaagccatttattgagttattgtacgccttggccgcccatgttctgctgtgcgaaagatactaaacgtttcgtgatttctcctccgacagaaccgtttgcacgagaagttgtttctccgccaaggtttacgccgaactcagaagcaatttcgtatttcatttggtcgattgcttgagcagcgccgggtactaatagttggtttgaagagttgttgtttgccatttgtatgatctcctttattaagtagtatggttgggtttgctggaattgcaccagccgatgattttcggaatgaaaaccattgccagctcggcttcacccaatgctgtttgccgctttgtactacgtattatggtgaatcaaagggcatctcattcggaaaaccgggtggtaaatagcggaagggaaaagaaaagcccagcctgatgcggctgagcttttagctttcagtcatatatgtgataaagcattaattcgtgcagctcttttacgagagccggctcttcttttcccggatgtgtgtgtccccattcaatgtcaccggacttatggtaaaccccttcgtaatgcgtaccctgccagtaaaatgaaatccgccatccgggcagtttctcttttttgaataacggtttccagctgaagtgcgaaatcatgacgttcacgctccttgtaggaaatgttgatcttgttcattgtagctcatcattctgtgcctgtcccgggtaaaaccaaaaaaagacagcctcaccgccaaagtttttccggggcggtgatggaccgttctgataaataggacgcgtattcaaaatttctccgttttgtcaggtaatcgaccgatctcagcttcggatgggaaaaaatgctgcgcccggggcgggaattggcttcaaacatccaaactttccctgaatgatcgacgccgaggtcaaaaccgatttcgccgataaaaccttcaatgtgctcatttaacacgcggctgaccgccaaggcggctttggaaagtttccgcatcatgccgactctctctcgcggatcgccgtataattcagctaacgtcctgacttctccgccggttgccagatgcgtcgtgatgctgttttcaccggaaatttttgctgcaatggccgtcactgtccatttcccctcggcgtttttattcgtgtgcaccctgaaatcgacggggcgtccatccagccggatcaggtcaatgccttgctgaattaaaaatgcggacgggtcattgttttctttaaatgatttcatgaaggatgccgcatctgaatactctgccgtcaccaccgttttttcctcattcgtgtgtttgacagataagccggcatctgttttttccaccctgtaaatccccgttccgagtgcgccgtctgcaggtttgatatagacggtgtcaaatgtgttgcataacgtctctaacgcctctgcattcgggtgcaggacagattttggaagaagtgaagcggtgagactgtttttttccagaagcttatgaatgtcccatttattaaagaattgcggattaaaccacggaatctgatagtcattcatcagcctctgttttgtctgctgtaaaagcggaactccttccgtttttcggctcgggagcctgtcatatacgacattcggaagcgggacggacgtccgtttccagctgttttctttataaatcagcgcttggacggtgccttcttcccagttgatctgatgagctccgaaaacgaaacaatatccgttcgcctgttcatgaagtgagagcatcttggaaaagaaggctgtacggtctcttaacgggcgggacggcgatgatgtgaacccggctgtgaaaacgccgatcagcggtccgatgtgcaccgtctggccgtgtatgagaaagtcagcccggcttttatacggtatcaacagctcctcaaacaaatcttcagaaaggagcgcgcttttttcaagtgattgagaaaaggctacacggcatttgacaaccttggtcccgaaggcagcggataaaagcccttcccgtttcatggaggaggggagaaacagcgtatttttgctttttttatcgatgccgacaatcatccctttatgattcacgcggtaatactcccttcctgctgtcctgtgactgaagttcgcggaagcgtctcagcggacccgtatacaaatcctctttcgcctccggagccacgcttaaaatagctttccgtcccggctttgaattgacatccaaaagccagatgcgtccgtctttggcataacaaatatcgagccccagctcaaacagcggtccgaaccgttcatcaaggaaataaggaacggattgggtgatcgaaaagacatcatccaataaaacggcctgctgctttctcggaatttcctcaaaccatatgtcaaacttaatcggttctgatcctccgggcaaatgagataaaagaccgttctgataaccccttctgaccgcttttccgaccgtttcccaaacgcctgactccgttttgcgcatgaaaatgcggatgtcgcacggatgccgttctttatcctggatatttaagtaggattgaagcaaatagcggtgctgcagcacttttttgcaccaagacttaaaagacacgtgattggaaaatgattttgtttgtttgttttttccgatatagtaagtggcggtaattgattttttgcctgtttcaagcaggatgatgcctctgcctcccgcgccgaaagcgggcttaagtatacatgctttttccttggctaagtataattgcacctgttcatagcggctgacttcggccgtttcaggaatatagggactgatcagatgatgcttttggagcgcatctgtaaccgtccatttatcaggaagcccccgcccgataaattccgttttcggatattttttcagccattcgacgatcggtttggctttttgcgcttcagcggattttccgtaaaaacagcggtcgtaaatatattcgggaatatcgatttccgtttcgttccactttccgctttgcgggtgatagacgagcgctttcacgcgcaaagaatccggaaatatatcaaacggtgtaaagcgggctaagcgcacattatattgaggcgctctttcagccaattccccggcgtaatcttcttcgtgccggcgggatacagacataaaaccgagtgttgtcatattactactccccctttattcaaaaagccgctgatggaacggcccttccatccaataaatatgctaagcgcatcataaaagatgatctactgtaaagagtacgaaacagcatcttgccttattcctcacaaacaacaattcaggttcttcatttgcccgcatgcccgccagcctctataatacgaatagatatatcatcaagaaaatagaacataagatggaggcagaagaaaaggaatgggcatagcaggaacgtttctatttatgatcgtgatcggagccgcgatcggcgcggtgacgaatcatcttgccattcagatgttatttcgtccgtaccggccgtattacctgttcggaaaacgggttccgtttacgccggggctgatcccgaaaagacgggatgaattggcaaaacaaatggggctcatggtgacgaaccaccttttaaccccggaaggaataaaaaagcggcttttatcagataacgttaaaaaccaggcgcttcttttcgccgaacaattcacgcaaaaaatggccgcttccgaaatgacggtgcacgaagctttggccgccgcgggcatccggaatccgcaggaaaagacggatgcctggattgaccgttttaccgatgaaaagctttcggacctgtaccggaaatatgagcaccgcgccatcaaagactggcttcctgatgagctgcaggaaaagctggatgaaaaaatcccgctggccgcagattatatcctgaagcgtagcattgattattttgagagcgaagaagggaaagacagactcggaaatatgattgacgactttttgaattcccgggggatgctcggcggcatggtgcagatgttcctcggcaattcaagcttggcagaccgtgtgctgcctgagctgttaaagtttttgcgcaatgaggaaacgaaaaagcttctggctgatctgctttctcaagaatggggcaagctcaaatcttatacactttatgaggccgatgaaaagtggaatgcgaaagatctgctgttcagcatgaaaaagcgggctttggccgcacttcaaaccgcgccctttttcgaatgccggctcggtgacatcatctcccgttatgaaggggagattacggggacgtacgcgccgaagctgcttgatgcggcactcggcagtattgccgctcatttggaggatgtgctgaaacggctgcgtcttgaggaagtggtcaaagagcaggttgatcagtttcccgttgaacggctggaagaaatggtgctgtcgatttccaagagagaatttaagatgataacgtatttaggcggtctgctcggcgggataatcggagcaattcaggctttgtttgtcattcttttctaaggaaaacatacgccgatgatgaaagtcgctccgcagtctgttatagtggagtggtatgtccgaaaggaagaaaggagcggttactatggcagttcatttttatgatgcagcatatgatcttgaaaaagctttgcgaaacagtgatgaatacagccgtctgagagggctttatgatcaagtaaacgcagatgaatccgcaaaacgcatgtttgataacttccgcaatgtacagatgcagctgcagcagaaacagatgtcaggtgaagaaatcactcaggaagaggtagagcaggcacaaaaaacggttgctctcgtacagcagcatgaattgatttctcagctgatggaagcggaacagcgcatgagcatgctgatcggcgagttaaacaaaatcattatgaaacctcttgaagagctttacggcagcccgcaataagctccacacccctccatctatgaaatggaggggtttttttattcaacagaaaaatcaagcgaaccttttaccgttccgttaatgatgacagacagagtgtgaattccccgataatgcttgcgggtggttaaatctttaagggaatgacgtttgctgaaggcttttacgtttccgttatccatggcggactccgacatcttaaacaccttgcggctgcggtgcccccttttctttacaaaatcaatcgcgtattcaaccctgactttttgccgggcggctgagcggatctgaaaagaaaaatgtatgcttgttccgatggcggccgtttccgaattcagtgtaaaacgttccaatgaaatccgggaggcgtcttcaaacccgaaaatcgcaagcgcctgtttgtctcctctttttaacagtgtcctgcaggcgtgcttcaaaatccaatccgtgtgcggacagcttccgaaccgctcggctgcggtctgtgccagaagatccggatgggttttggagatgtcattcaggttattcgccacgctttttctgacatataacgagtcatcctgcatcaagcggtccagaacagggagaatcggagaaggatcttcaagaagagccggaatggagattccccacggcaggcgcggtcttgagccctcgctggcaagccttctgacatgttcgtccggatgctccgtccaggaaaggaactctttgaacatccgctcccggtcaagcctgatatacgggcggaccgcaaattcggaagtggaaaaacgagtgaaaaactgaagcgccttcattgattcttcccagtgatccgttccgtactgttggacataatcgggaaaaataatcccggcgagccctgtgaaatggggagctgtctcatataagacgtcaagcgcccgtatgtaatccttcggcagtgtttcatataaagagtctgtgatccggcgcatccgctgttttaacgtcagtccgggccaatcttcctgaaatatcagcgcccggcacttgtcccgctcaaaagccggatacgccgatttgactctgtgcagaagtgcttctgcaaattcttcgttataaatatcttttaatagagacatgacagtcaccgctttttttcttttattatatgcgaatatacgttccttttcaattttatcatacattcagcacagatagttcccctgatttttttagttaaaaaaacccttgttttttaacaatattattgagataataactctgaaagcgcctacacttacagatgatctaaggatacggtcgcctatactgcctggtatgttaaggggtagcaacagagagtaagtgaaacgagcgcatcaacggtcaaataaggggttcctgatatatttcgttaatagaaatgcacattggggagaaggcagcaaatcgatcgtatcccaacaaaacgacagttcaaagtctgcttgaggcaggcttttttgctgcggagaaaaggttgttctaaacaaagagacagggtcatatcctaatgacaagtacagtcatcaaggagggggacttctctgtgtcaaaacaaatgctggcgttaaatatagacggagcgcttcttcgctccaacggcaaacttcatcagacgacaaaggatgccatcgaatacgtcaagaaaaaagggatttacgtcacactggtcacaaaccgccattttcgctccgctcaaaaagtggcgaaaatattaaagctgaatgcaaaattgattacccacagcggcgcatacatttctgaaaaaatagatgagccgttttttgaaaagaaaatatcagaagatcacacgtttaatatcgttcaggtgctcgaaagctatcaatgcaatatccggcttcttcacgaaaaatattcgatcggtaacaagaagaaagtgaactccaatctggtcgggaaaacgatgattcatccgtctgacccgatcttttatccggtgcagtttgtcgaatcattaagtgacctgctccttgatgagccggtttcagcgcccgtcattgaagtgcatgctgaagatggcctgcaggctgatataacggatacgataatgaaagcattcccggccgtcgatgtgatccgcgtcaacggagaaaaactgaacatcgtgcctaaaggggtttcaaaagaaagcggactttcgatggtcgccgctgatctcgggctttcaatggaagaggttgtggctatcggccatcaggaagatgatctgccgatgatcgagctggccggtctcggcgtcgcgatggggaatgcttcaaatgaattaaaaagaaaagcggactgggtgacaaggtcaaatgatgaacagggagtggcttatatgattaaggaatatttccgcatgcagcaccgcaaaggctttctcgataagttccatatgaaacggccgtaatcaagagccgcagacgcgaaacgccggtctgcggctttttcgcggattgattttagcctgttctttctgtacactaaagaaagttttgaatctgaaaaataaggtgatcacattgcaaataaaaatagacggcataacggatgacaggctgcatcgtccgctgcaaaacatcgcgaatttattttttgaagagtgtgttcttacgtacggcgaaacggaggaaccctctgatctcgtcatctcacttgccatttctcaagatgcagacagcgtgtcggtatccggagaaatcaaaggaaccggcgaaaaggaacatcacacgaaaccgcttcttgccggatggagcgaaaaagaagtatttaaacaggtgaaaaacacgctgtcatatgtctacttaaatcttcttcaatcacatacgggcatgacacaaaaatggggaatcttaaccggcatcaggcctactaaacttcttcataaaaagctgcagagcggcctgacaaaagaagaggcgcatgccgatctgaaaaaagactatctgatccatgatgaaaaaatcaatctgatgcaggagattgtcgaccgccagctcgctgcggttcccgatctgtaccgggtcaaagatgaagtcagcatttatatcggcatcccgttctgcccgacgaagtgcgcctactgcacgtttccggcttatgccattcaaggacaggcgggaagagtcggctcctttttatgggggcttcactatgaaatgcagaaaatcggagaatggctgaagcggcatgatatcaaagtgacgaccatttatttcggcggcggcacgccgacaagcattaccgctgaagaaatggatcttttatatgaagaaatggtccgctctttcccggatgtcgcgaatatcagggagattaccgttgaagcgggccgtcccgacacgattacggaggaaaagcttgccgttttaaataagtataagattgacagaatcagcatcaacccgcaatcttatgaaaacgaaacgcttaaggctatcggcagacaccataccgttgaagaaaccatcgaaaaataccatctttcccgcaaacacggcatgaataatatcaacatggacctgatcatcggcctgccgggagaagggacggctgagttcaggcacagtcttgaagaaacggaaaagctgatgcctgaatctttgaccgttcatacgctttcttttaaacgggcgtcagaaatgacgagaaacaagcataagtataaagttgccgacagacaggaagtgtcccgcatgatggatgacgccgtccgctggacaaaagagcacggctatacgccgtactacttgtatcggcagaaaaatattctcggaaaccttgaaaatgtcggctactccttcccgggtcaggaaagcatctacaacattatgattatggaagaagtgcagacgattatcggtatcggctgcggggcggcaagcaaattcattcatccggaaaccggaaaaatcacgcacttcgccaatccgaaagacccgaaatcatataatgaccgattcgagcattatacagaagagaaaatcaaatacttagatgagatgttcgtcaaatctgcattataatatcaaaaacggcacggaatcagcgtgccgtttttttatgtttaaccgtctgtaaaaacgggaaaagatcatcagactgttattcgcaagaggtgcataatatgtatgatgtcataggagcgggaatcgggccgtttaatttagggcttgccgcattgttagaggatatacccggaacagacgctctttttttcgataaaaagaaagaatttgcgtggcatcccggtctattaattaaaggaacggatttacaggtggcgtttctggcggacctggtcacgctcgccgatccgaaaagccgctacacgtttttaaactttctccatgaacatgaccggctgtaccggttttatacgtttaatgaatttgatattccgagacgggaatttaacgactatttaagctgggcggcttcagaaatcaaatcatgccgtttcggctcagaggtaatcggcgtgaaaaatgccggcggacattatgaagtcagcgtcaagaacattgaggacggaagcatcagtgtctatcagacgaagcatttcgtcatggggacggggtctgaaccgcttattcccgcagagattgatgacggagcgcgtcaggacacgatggtcagcacggaatatttgttccggaaagacgagctcgccggcgccgaatcaattacagtggtcggctccggacagagcgccgcggagatcttttctgacttattgcatgatgaacaataccggcgcagccggctgcaatgggtgacacgctccgccggatttcgagaattggaaaccgccaagctcgggcaggaaatgtttacacctgattatgtggaatattttaaccgcctgccttttaaagaacggctgaacacactccctgagctggacggactgcgccacggcattgattctgacacacttgccaccatttacgacgccctgtatcacagatcgatcagcggaggttcgcctgacgtgtatattcagccgatggcggagcttgaaaaaattgaaaagcaaaacgggcgctgtgtactgagctttcatcaatggcagatggatgaaacttttacggccgattcagaaaaagtgatattggcgaccggctttaaacctcatattccggaatggtttacggcaatcgccccgatatcgaatgggaggatgagaaacggtttaaagtgacggccgattcccgtcttgtctttaaggacgacagacggcatcattttttcacattaacgaatcttgatcatgctcacggaacgggcgctacgaatttgaagctgtctgtttacagaaaccaaaaaatcatcaataccattctgggaaaagagcatttctccattaataaaaaaacggcttttcagcaatttcttcccgctcaaaaaaactgacctcttatgaagaggtcagtttttttttatgatttctgcggcttcttttcaggcgtcttccatttgaatacgctgttcagcaggagatatatccgcttcgattctttcgtgagcaaagggccgaagatggccagtatcaaaacatataaggcggcgaaaggtttaagtgaagcggacaggccgccggcgatgccgagatttgcgacgataatggagaattcgccgcgggacacaatggtcagcccgatattggacgatgctttatgagaaagccccgcccggcgcccggcgatcatgccggcgataaagtttccggcaatcgtcagcagaacggcgccgagggcgagccataccgcatctccgagtgaaaacggatcaatgctgaggccgaaactgaagaaaaacatggcgccgaaaaagtcacggaacggcacgacaagatgctcaatcctgtcagaatgggccgtctccgaaaacacgagcccgagcaagagcgcgccgatcgcttcagcgacatgaatcgtttcggaaaagccggcaatgaaaaagagcgcggcgaaaatgacgatgacaaatacctcgtttgaacggatatcaagcagcttgttcagcagaggcggcaatttccgggcggcaatgaaaaacagcagcatatatccgaaagcgatcacgattgacatcagcgcgcccccgacagacgtcgcgtctcccagaacaagcccggaaacgacggataagtaaaccgccagaaagatatcctcaaacataatgatgccgagaatcagctccgtttccggattggccgtgcgctttaagtcgacaagcacctttgcgacaatggcgctggatgatatcgtgatgacgcccgccaatacaagcacttccaaaaaggaaaagcccgtgataaatccgtagatcagccctaaactgaaattaatcagaatataaatcgttccgccggcggcgattgaacgtccggatttgactaattttccgactgagaattcaagcccgaggtaaaagaggaggaacaggacgcccatccgtccgaaaaattcaatcacttcccggctttcgataaacgtcagatcaatgatgcccgcctggggcgcgtgcggcccgacaagcattcctaaaatgatcaggaaggggatgatcgagaatttaattttattggcgatgacactcgcaatggccacaagaactaacgccgtaccgacttcaaatacgagatggtccataaacagatcacactccgtctctggagaggaagtcttggatcagttttttcagatgctttctttcacctgagaggacgagtgtatcgtttgcttcaaggagcgaatcagcccccgggtttaaaaactttttctggtcatgctttatgatggcgataaccgtcacgtcatagttttggcgcacatccagttcgccgagcgtccgccctgccgcttttgcccctttttcaactttaaaccattcgataatcagatcgctgaacgccatttcaatcgattcaagcgcctgcggtttgtacaccatcccgccgataatcgcggcaatctgtcttgcttccgcatcatcaagtgaaatgcttgccagaagctcatcagggtcgcggtcatcaaatctgtaaatttcccgcctgccgtcatcatgaatgatgatcgtcattttttcatgatttctcgtttcgatttcgaattttttcccgatgccgggcagatcgttttctttaatattcataaaaaatccctccggaatatactgtttttacaccgtaaatacagattggcaatgagaaatggtctgatgccggaggtaatttgactggtattgtatcggaatggcgcatgtcctttccattgtggaatcaatgaattgatcaagaggtttgacagataacagggagatcatccgggataacgcaccgtatccttttgacaggccttgcggagcggttttggtttgaaccggcgtctttgccgattccgtttcctgcgggtagaccgaaatttgtacatggctgtctgtttctgtcaccaattgggaaggaagagcgacatccgaaggggggaacagcaccataaaaaagctcagtaacaagctgagtatcacatatttcattatcggtgtttttcccccctttttgttttgtatatcaatttcactatataaaaatgtatgttcagtttcaaatgatatgcatttttcggtatctgttgaccttgaaaaataaaggagtttcgcttcgggggaaggaatatatcatttgaacaaaatatgtaagcggattcaaggagggagtaaacatgcagtatattcgttatgaagaaaagggaaagatcgcagagattgtgctgaaccgtcctgacagttacaacgcgctgaatgaacaaatgctccgggaattggaaaatgcatgcgttatggcagccgacagcgaagcgcttatcgtcctcttgcggggggaaggccggggattttccgcgggcggtgatatccagatgatgacgtcggatcatgattcgggagaatatgaacggctcatgaaaatgattgaatccattacgctgacgctctatgatatgaaaaaaattgtgatagccgccatccacggagccgcggcggggctcgggctgagtttcgcgctgtgcgccgatgtggtgctcgccgaagaaaacgcccgactcgcgatgaatttcatcggcatcggattggttcccgacggaggaggccattatttattaatgagacgcgtcggtgagatcgaagcgaaaaaactgatttggagcggtgaaaaattgccggctgaaaaagcggtgcggctcaagcttgccgacgggctgttcagcggcggccctgcggagggggcacaaccgtatatcgaccgattgctgcatgcgccgctgtcagcgatgattgaaacgaaggctatttatcagagcctccatatcagccggttaaaagacgttttatctcttgaacgaaaggcccaggaaaatatgagaaaaacggatgatcataaagagggcatccgcgcctttttagaaaaacggacgccgcaatttaaccggtaaaatacagaagccggaaagcttctgttatctgtggaataaaatcagctttccggcttcatttaccaagcggtgagtactgttctcaagctttttttcctctaacaaagcctctccggcggccttcgcctccgcctcattatctgcttcgatccgttcatccagcagcgtttctcccgacgcatggaatgcggtcaatacatattgtcccatcatgtcaccccctttatagaatgatattctgataaagaatttaaaatcctccattaatttttacccattattagtatataatgggtcaaggaaggagttggattcgtgcttacaattgaaaatgtaacgaaaacattcggcagctttaccgctgttgacaatttgaacctgcaaatacctgaaagggaaatgttcgggctgctcggcgcaaacggcgcgggaaaaacgacgacctttcggatgattttaggtcttttaagcctgactgacgggcatatcacctggaaagggaagccggtcaattattccatcagtgaaaaaatcggctatctcccggaagaacgggggctgtatccgaaagtgaaggtgagtgaccagcttgtctatctggcgagattaaaaggaatgagcaaaaaagaggcggaaaaagagctcatgacatggctcgaacgcttcggcattacagattacaagaataagaaagtcgaagagctgtcaaaaggaaaccagcagaaaatccagttcatttcggccgtcctgcataagcctgaactgctgattctcgatgaacctttcagcggtcttgatccggtgaatgtcgagctgctgaaagaagcggttatttctttgaaaaacagcggcgtttccatcgttttttcaagccaccgaatggagcatgtggaagaactttgcgagaatttgtgcattctccagaagggaaaacccgtcgttcaaggcaatctgaaagacattaagcggtctttcggcaaaaaaaatgtcaccgttcattcagatgatgacctcagctttttaaaaacgcatgaaggtgtcgtgaaatggaaggaaacaaatgacggaatcagactgcaggtcgcgaatgaaccggtttcgcaggatattttccgggcgctgcaagggaaaggttttatacggaagttcgaattggaagagccgtcactgcatgatatttttatagaaaaggtgggggccgtatatgaataaattttggattatgctgtttcatacatataaaaacaaaatcgcaacaaagtcattcattatttcgaccgccattaccgttttattagtattagcggtgaccaacctgcaatcgattatttccgtgtttcaatcggatgacggcaagcagcaaatcgcggtgattgatgaaacgggcgggctgtacccggcgtttgcaaaacagcttaaagcggcggatacagacaatgatctgcaggcaatggagacgaaggagtccgaaaaagatgccgtaaagcgtgtcaaagacggtgaatgggacggactgtttatcatcagacaggatcaaaaaggaacgataacgggagcatacaaggcgctgaccatttctgatgaatcagcgtataaactgctcaagcaggctttaacccagacgaaaaccgctgtcgaaaccgccaagctcggcatttcggcagaaaaagtcagcagcctctacactccgccggaagtcagcaaagacgcgctggaaaaaggggcgaaatctgaggaagagctcggtcaggtaatggggcttgtatacatcatgctgtttgtcatctacttctcagttatcatgtacgcaagcatgattgcgatggaagtggcgacggaaaaatcgtcccgcgtcatggaaattttaatttcaagcatgccgccgattcagcagatgtttgccaaactgttcggtatcgcgctcgtggggatcacacagtttgcggtgctgattgcagcgggttatctctcactgaagctgaaccctcaaaatgatgcgtcgtcgccgatcagtgcattcctcaattttacggatgttcccgtctcgacgatagtctatgccgtcattttctatttgctcggctattttctttacgcgacgcttgccgcgtttctcggcagtgttgtcagccggatagaggacgtacagcagacgattcagccgatggtttttttggtcgtggcaggttttatgatcgccatgttcggcatcggcaatcctgacgccggttttattaccgttacatcttacattccgtttttcacgccgatgattatgtttttacgcgtcgggatgctcgatatcccgttttggcaggctgcggccgggatcgccctgacactggtcactatcgtgatctttgcggcggtcggcgcgaaaatttacaaaggcggcgttttgatttacggaaacgccagcggattcaaagcgatcaaacaagcgctgcgcatctccaaaaaataaatgaaacagcccggaacagccgggctgtttttttattttacagaacgtgcattcgtataaaaacggtgctaaaataagggtaattcaatctgcagaaaggggagggcgagatggctgatctgacgtttattcatgccgctgacctgcatctggacagcccgttttacggcatttcgaatctgcctgaaccggtatatgcgcgtattaaagaaagcacatttcacagcgtccgccgtctgacggacggggcactccgggagcaggcagatttcgtgctgctttcgggggatctgtttgacgaagccaacagaagtttaaaagcccagctgtttttgagaaaacagtttacgagattacaggaagcgggtatccaagtgttcgtcatattcggcaaccatgatcatttgggcggtaagtggacgccgattgaatggccggaaaatgtacatatattcacctcgggtacaccggaggaaaaatctttctttaaaaacggagagcttgcggcaagcatatacggatgcagctatcaggaaagaagcgtaacggtcaatcaggcggcccgttaccggaaaatgaccggcgcgccttatcatatcggcatgctccacggcatgttatcaggagcggaagggcatgacccgtactgcccgtttacgaaagaagaccttgaaaaaagcggcatggattactgggcgctcggacacattcataaacggcaggttctgtccgcccagcatcccgccgctatttaccccgggaatattcaagcccggcatttaaaagaaaccgggcctaagggatattatctcgtccgggcggcaaacggtgagatgtcttgggaattcaaagaagcgcatgatgtgttatgggaggaaattgatcttgatatctcaggagctgaacatatgacttcacttctgaaagccgcatcggatacattctccggcttgcgcgcggcgggccgcccggcatgtgtcaggctggtgcttcgcggcgcggcgccccgcttttggacggaggcgcccgcaggcatcgcagaggagtttctttccgctttacaggaggaagaggccgaagaggaatgtttcgtctggccgcttgcgcttgaggatcggacggatgaaacagacagcgtgccgcccgatccgttttttaaagggctgcttcaggacatagaacaatgcgcggacatgagcggtgtatttgaagcccttgagcgtcatcccgtatatcggcgtcagatcacttcatttacagatgaagagatactggatattaagcggcaggctcaagccgttttaagacgccagatgaaggagcttcagcgatgaaaataacggcaatgcatatttaccaatacggaaaattttccgaccaaagttttcagctgtcagattctcccgtgcaagtgatctacggattaaatgaagcgggtaaaacaacattgatgtccttcatcaaaagcgtgctgttcggttttccgaaatcaaaaaaatacgaaccgaaaaacggcggggtttacggcggcactgtggaattgaagcatggcgatcacggtgccgtcaaaatcgaacggacaaaaggcgctgccgaaaaagtcagagtgtatacggcttcaggcgaaatcaaggacggagaatggctcaaacagcttctctccgatacagaccgggcgctgtacgaagcgatctattcgttcgatgtattcggactgcaggagattcaagcttttaaccgggacaaaatcggcgagtttctcctgtattcgagcttattcgggtcggaagcggcggcaaagcttgacgggcggctggcaaaagaacttgaaaggatgtataagccgaacgggcggaacccccgcttaaatcaggagttggatacattaaagcggctcagcgcccagctgaaacaggcggaagctgcggaagcgggctatcacagccttctggaagagaaaaaaagcgccggcggccgtttgcaggatgccgaagcacgattgaaagacataactgaagaaatcaaaacagtaaaatcggcgatagaagcaaagccgctcgcagacaaaaaaacagccttggaaagcgaactttcttcttatccggatgcattgaagcaattcccgaaggacgggatgcatcagcttgaaaaatacgaatcgcatctccatccgaaagctgcccgtcttgagggacttcgggcaaaagctgctgaactcaggcggcaggctgagctgctcgctccaaatgaggacttgctgcaaacagagcggcagctgcaggagctttccggcgagcagcatatgtacgaatcgcgcggtgaacagcttgccgccatccaatcacagatccggcagacatctgcccgcgttttgtcaggattgcagcagctcggaagacatgaggaagacggcattctttcactgaacaccgattatgaatatgaatggcggctgcaggaagccgtgcagagcgccggacaggcaagagaaagaaagacacagcttgatgcgattttcgaacaagcgcggctggagctggaagaagccgaacgaaaacatgccttgacgtcggaaaacattttggaccccgctgtcaggaaagaaaaagaagccgctttacaatcatataagcaaacggctgatacagaaggaaacgaatggcaggcacatgtacagcagctggaaaaacagcgcgccaaacaaaaaaagctctttctcggtgcgggcattctgttcattgcgattttcgctatgttaaaggaatggctgcccgccgccctttttaccggcgctctgctgctgtatatgctgtccggcatgcaaaaaccgctgccgtcagaaagaggaggggccggtcacaagaaaaagaagccgacgatctccaaagaagcggctgaccttctgcaggaagagctttggcgtgacggccggcaccggcagcagctgattgcggatcaagccgtgcttgaacagaaagaagcggcatatgaaagagtcatccgccaatatgaagaatgggaggcggaaatggcgccgtctgaaaaacaggcggaactttttatgaaggaactgggtttttcaggaagtccttcccatcttcttgacgcatatcatgtgatgaaagatgtcaaaaaagaaatccttaataagcatgagctgaccattgaagcgggccggctgcaaaagttgcaaagagcatttgaggaccgggtcaaaaagctgagtccttcagacggaagggagctgtccgtaaaagaaagactgcgcgttttgctggtacaggcggaacgggcccgtgaggaagcaaaacgaaagcaggcgctcgaaacggatctgctgcatgcacaagagcaaatgcgtgaattaaacgaagaagtccattactacgaacagcaggtcaaacagcttttcatggcggcaggcgcaaaaaatcgcgaacacttttgtgaactcgccagactgaatgaaagccgccgggaaacagagcggcagctgcgcgaaatcaaaacgcacttgtccggcataggcggaaaacagcttgagccgtatatgagccgcacagtgtccgaacttgaacatacagtcgttcagaaggaaacagagaaaaaaacgcttgaggaaaaaagcgcgcagctccgtgagaaaaccgctttattaacggtgaaacaagagcagctggagtcctcggggcttgtatccgatttaaaacagcagacagaaatgcagaaggagcgcgtgaaaaaaaccgctaaagagtgggccgcattacagacggtcagacacatcatcagggaaaaaatggagcggcataaaaaagtgacgcttccccgtctgttagaaaccgccggtgcattatacggaccgcttacggacggacgttaccataaattgtatttctccgaggcggatgattccattatggtcatgcggaaagacggaactgtgttttcagcaggcgaactgtcacaggcggcatgcgagcagctttatgcggcgatccgttttgcccttgcgtcagagagggaatctgcggtatcacttccgtttttacttgatgacagttttgtccattttgacaggcagcggctggagcggctgtttgatgtgctgaatcagctttcagaaggcgggcggcagatactttatttcacctgccatgagcatgtcagccggtcttttcacagcggacaagtcatgcggctcctgtcataaaagagtttattttcaaaaaagaggtatgtgctatactggtattatgtaagatatggagggagcttttaatagaatggcaaaaggtattatgctgcacgaggtcggcgagcaggtcgatcaatactttctgattaaatcttcgactaagggaatcgcaagcaacggaaaaccattcctgacgttaatgctgcaggaccaatcgggagatatcgaagcgaagctgtgggatgccaagccgactgatgaagtaacgtacgcggcgcagacgatcgtgaaggtgatcggagatgtccatcactatcgcggacgaaaccagcttaagctgagaaacatccggccggccggcgagaacgaaaatgtcagcattgatgattttctggaaacggcgccgattccgaaaaatgaaatgatggaaaccgtcactcaatacatttttgaaatgaaaaatccaaatatccagcggatcacaagacatctggtcaaaaaatatgcggctgagtttatggattacccggcggcggctaaaaaccaccatgagttcgtctccgggctcgcgtatcatgtagtgtccatgctgaacctggcaaaagcgattgccgatctgtatccgtctcttgaccgggatttactgtatgccggagtcattctgcatgatctcggcaaagtaaaagagctttcaggccccgtctccacgacgtacaccgtggaagggaatctgctcgggcacatttcgatcatggtgacagagctttcaaaagcagccgaagagcttcagattgacgctgaagaagtgctgattctgaagcatttgattttaagccatcacggaaaagcggaatggggaagcccgaaaccgccgatggtgaaagaagcggaaattctgcactacattgacaatctggatgcaaaaatgatcatgatggacagagcgctggaacgggtgaagccgggcgaatacacagagcgtgtatttgcgctggaaaaccgttctttctacaaaccgacgttccatcaataagataaaaaggccgattctctatgatcggtcttttttacgttcagctctcataacttgtctttatcaagcatagcttagaataaagactctgggtgaaaaagggaggaaaccgacgtgctattttttccttggtgggtatacctttgcattatcggaattattttcagcgcctataagcttttcacaacagctaaagaagaggaaaagcttgaccagtcgtttattgaaaaagaaggaagggtgtatattgaacggatggaacaggaacgcgagcgccgtatggcggcgcccgcaagtgaaaacacggatgcagaagaaaactccaatcattccatcgcataaaaaaactgtgcggggctcgctgagagcccgcacagttttttttatttagattcagaagaagttgaagtgttaaacgtgtcttttaagtctttgtcttccacttttacgtcagcttttttcatgactttttgaattgccgcctgtacagctgagttgtcgtttaatttctgtttaagaacttcttctttcaactcttttttcatgtcatcatatttgccgcgttcctctgtctttttgatgatatgataaccgaattttgttttgaccggatcgctgacttgtccgactttcagaccgaatgcagctttgctgaatgtttcatccattgactttttatcgaaccagccaaggtcgccgccgttgtcttttgagttgtcagttgaatattctttcgcaagcgtttcaaacttctcgccttttttcagttttttctccacttcgtcagctgtctttttgtcagcgacaagaatgtggctcgcccggattttaccttttaagccgtcgtaatattctttcgtatcagcgtcagtcactttgatgttgtctttcgccgctttttgtgcaagcagttcgtacttcacctgatctttcaggtaatcttcgccgtactgctgtttaagggcgctgtactgatcgccgagctgcgttttgtactctttcagcttgttatcgatttctttatccgatactttgtatttttttgctaatactttttcttgtacgagctgtgtcagcacacttgcgcccgcggtttttttcatattcgtgtagagttcgccttttgttacatttccggcatccgtcttggcaatcacgtcgttgtcgccgctgctgcaagcgctgagagccaggacgctcgttgccgtaatagctgctatcgcgattttcttcattcctttaaacactcctaatcatccaaattaaattgcatatgcgtatcataacatattgtggctttctgtaaaaagattttaaataaagggcattcgtctagtcaaactttttcctgatacatacaaatatattgatcatgaaaaggaggtaatgaaccatgggcggaggatattcaaacggtttcgcactgctcgtagtactgttcatattgcttatcatcgtaggtgcagcttacatttgttaagcgaaacggatcgctttttctaaaagcgatccgttttcttacccgggcgcctaatcgtttcagaagtaaattgcatatgatgtaattggaaaaataaaacgttttgtaggaggtgcttttggagatgggtgaagtatttgcaggcggttttgcattattggttgttctgttcatcttattgatcatcatcggcgcttcttggctttattaagaaaaaaatatggctgtcgggggtcagacctccgtcagccatatttttttgcctgtttacacagtaaaggagatctcgacgaatgaagagatcagtaaaattaaaatagatacattaataaaacggaataccttatcctgccggtcttcaggaatctctctgacaaggcataatgtatttgtgagcctgtttataaaataaagaataaacagggcagccacgataaaatagaataaaatgatgggagattccccctctctctgaactgctcccatattacattaccaaatatttattaaaaaagatagaatgtaacctgaaaaatcagcgggatatcaagactccggcactttttttactaaaatatcaaaaccgtcggattcctggtcaatcagacatgatttgggcgctttgaccaggtgcagcgcaaacagaagatcaggcaggcaataacccgcatgaatgctcgaaatcatataaaagtaatgagcgtgtctcggaaatgccagtccggcataaaacaatagcggcgtaatgaataaaaacgggctgatcgtagaaatcagcatcgtcgttttcggtatgcctttccatgtcggcatccgcaagaagtacattttcatttccttttttctttttttacagatcatcggcaggacatgtatgactttatgtacaaataaagtaacaacgagcagaacacaaaaagcaaacacgtgcccgtcacttaaactgatattcggacgcagcagcccgaatgccaagaagttgcatataaaaaacaggatcataaaacctacagcagtcaataataaacgaaccgcaccataatctttgatcagattaatggttttccagcaattcatcagagtcatccttccgtacaaagatggaatacaatctcaaaataatttactctcttcaggagaaaaaatcaatccttttttaaagaaaaaaaataaccccggaaagggaagaacagaagagctcggtgaaacatggaaatgtacggtttaacctttcttctccattcattatcagctaaaataagattaaagatagaaagaagtgaaacggatggattcaatggatcagcgtatcgggcgtttagaatattacatacaattgctggtgaaaacggtggatatggataagtaccctttttatgcgatgatgattgaaaaagggctgaccgaagaagaaggagaagaggtcgggcggatctgccgcgaattggaggacgagctggagtcgcaaaaagcgcaaggctttgtgacgtttgacaagctccttgcgctttttgcgggacagctgaacgaaaaattagatgttcatgaaacgatttttgctctgtatgagcaggggctttatacagcgctgatggaagaatttattgagataatgaagcactttgattaactgttgatcggttccagctcttcagccgtttcatggacagccgattcgtctgtttttttcttcagccttccgtcttcactatcaaaatcattgtttatgtttgtcaatgatttctcgaatatctccataaaatcttcgccgtaaatgtggcggatgacacaggttaattcttcaacttccggaaacttcccgaataagtggtagatcggctgtgagcctttaaacaccgcgtttctagacgggtcaaactcctcaagcaggctttcgaatacattttccccttcttctgttaactgaatgtacgtgttccgtttatcattcagccgcttggaaaatttcagatatccccgttcttcaagcttttttgaaaagttaaatgcagttgatacgtgcataacgccgaatttggcgatttctgaaatagaagctcctttaagctgataggcaatccataatatatgatgctcattaatattaaggtcgtacggcttcagccaattctgccagtctttctcgatagatttccagagtgctttggacagctgcgccattttttgggtatagattaaagcttcttttagatcgtaaggcggttcaacacgattcaatacagatcacctgcttcacattttcttttcctctattatgccaataaaataaagattaataaagatgaaaatttaagaattttataataaattcttaatccgttgctgtgaaaggctttaaaccgcaaaaaaaagtgcggaacgcaatatgcccgcactttttttggttgtataggatattagttttgtaaggttttctccagctgtctgattttctcttcaatatcagcgatttccttttgaagatcctgctggtgcggcttgatttcctcctgccaccttttaatgctggtctgaagctctccgcctacgtctttaatgacttctgcgctttctttcgccgtttggacaagctggtctttaagcgccattccgtctttttttaaccgtttgattgtgtcctcaattgaattgcaattcgctttgattttgccccgcagctcttttccggatgaaggagccgaaagtaacaccgctgcgcctccgatcaatccgcctacgaaaaggcctgttaaaagggaacgtccgtcagccatttaaaatcaccccgttttttttctcataacttttatcatttttgttcagaagaataaacttctatacatagcttgctttattttagcatattttttaagggaaaaggagggagaaggttgtctgtctttatgattgttttatcttgtatggctcttgtctttgcggcgggcgccgtttattacctgaaactgctcggccaggccgcttcttatccgccgaagcgggtcgtccgccaaaaggccatcgtctgctcagcaggaaccgccctcgcattgttccttatctttttcacaaaacttctcgtataaaacatgctgaaacacattaaaaaacctcttccggccggaagaggtttcggtatgcggttatttcaccgtttcaatcatattggaccgttttaagatcgtctgcacaatcggatgcataatgataatggcgatcgcattcagcgcagccgccggaaggacgaccgcgagcaccaaggcggtgaatccccccggcaggccgacaatcagaagggccagcgccagaaagagcaaaccggagatgaaggtgccggctattgtaatgacggcggcggccgctgttttcacgctctttttcaccaaaagcgccagcgcgagaaacagaaacgccgttaccggtttttcaatgatattcggaagctgtccgcccggaaaagatgtcgtgagtgcggaaatgattcccgttacaatcccgatcatcagcacgttctgcacacggggaaataacagaatacccataaacatcatcacaagcatcatatcgggtttcattccgaataataccggcggcataatggaatgaagcaccgctccgattgccgcaaacagggccataatgactaattcttttgttttcatactaagctctcctctgctaagctttttcgccatccaataatatgctcgtcatttattgcgatggccggaaaaattgatatgcaaacagtatatcaaaggaaccgttatgttagaagaaatttattcgttttcctgctggaactttttcataaactgagccagtttttcacaatcagccaggctgacggcgttgtagatagacgccctgcatcctccgactgagcggtggcctccgagtccggtcattttagccgctttcgcttcttcaacgaattttttcgtgagactgctgtcgcggagggtgaacgtgacgttcatgtgagaacggctgtcttttgcggcatgccccgcgtaaaaaccgccgcttgcgtcgattgtgccgtacaggacgtcggccttttcatgattgcgccgttcagccgcttcgacacctccgttttcagccagccattcaaggacgaggctcagcatataaatcgcaaatgtaggcggcgtattatacagtgaatcggcttttgtatgagtggagtatttcaaaattttagggacgttggcgttttcgttttcaagccatgattttttcatgatgacgaccgtgacgccggacggaccgaggtttttctgggcgccgccatagatgacatcaaacgttttgacatcaatttttctgctcaggatgtcgcttgacatgtcggctacgagcgggattggtgaattcgggaactctttccactgcgttccgaaaatcgtgttattggacgtaagatgcaggtaggcgccgtctttgattcctgtgaggtccgcttccggtatatggttgtggtttgaatctgcgcttgttgccgtgacggatgtgtttccgaacagtttcgcctcggcgagtgctttttcagaccatgcgcccgttacgatgaagtgagccgtttgctccggcgttaaaaagttcatcggcagcatggagaattgaaggcttgcgccgccttgaagaaataaaatatcataatcgtcgggaatatccatcagttctttcagaaggctttttgctttttgatgcaccgcatcatattctttgcttcggtgggacagctccatgacggacatgccggtgtcattgaagttgacaaattctttctgtgctttttgcagcacatccagtggaagggctgcgggtcctgcattgaaattcgttgtacgttccatgtttacgatctctccctgttttccgctttagtgtaagaaataatacaattatcctatcacaattttttgatttttttgatatgaaaaaatataattttatgttttttgtgttgccggacgcaaaaaaacctcatctttaagatgaggcaagccgttttctgacggttgaagcgatctcctgaagatcgtcaggcgtatagtcttcggcgtgggtcttccagacagccccgaaaccgtcgccttttccgtaacgcggaatgatatgcatgtgaaaatggaacaccgattggcccgctttttcaccgttattattgagaatattcagcccgatcggctcgaattcatcgcggatggcgcgtgcgactttcggcaccgcttcgaaatattctttagaaagctcaggcgtaaactcgtacacgttttcgatatgtgttttcggaatcacgagcgtatggccttttgtgacttggctgatatcaagaaacgccacaacatgttcattttcgtatacttttgaagacggaatgtcaccggcaatgattttgcagaaaatacaatcgtccgctttgtgcatagatgggtttcctccctgaaaagaaatatatgtatattctcatcgtaccacaaaaacggtcaaaacaaaaaacaggatgaacggctgcgcgttcaccctgatgcagaagtacgagctttatcacagaaaattaaatatgccttttgtaagcacctcatttgtttttaaaatgaagacttatgggtctgcttaatcattcctgggacaaacacctcatttgattatttcatcatgaatgaagaacatcatcaaagcagtgtgtgaagaaattgtaagcacaggacatgttgattttcatccaactgttctaagacgtcttttataaacacctcattttcagttgattaaagctgtttccttctacatacattatgatgtccgccaaaacgataactatgcacgcttttcacgtgagaaaaaaagggaatcgtttcaaatcagactttatttttggtactatgaagaaaaacgaatcagaaggggagaaattatgtctctgctatcggtaaaagacttaaccggcggttatacgagaaacccggtcttaaaaaatgtttcattcacccttgagccgaaccagattgtcggactcatcggattaaacggcgcgggcaaaagcacgacgatccggcatattatcggattaatggacccgcataaaggctcgatcgagctgaacggcaagacgttttcggaggataaggaaagctaccgctcgcaatttacgtacatccccgaaacgccggtgctgtatgaagaactgacgctcaaagagcatctggagctgacggccatggcgtacggcctttccaaagaaacgcttgaaaaaaggcttcctccgcttttgaaagaattcagaatggaaaaaaggctgaaatggtttcccgctcacttttccaaagggatgaagcagaaggtcatgatcatgtgcgcgtttctcgcggagccctcgctttatatcattgacgagccgtttctcggccttgacccgcttgcgatcaatgcattgctggagcggatggacgccgcgaaaaaagccggatcaagcgtgctgatgtcaacgcatatcctggctacggcagagcgctactgtgacgcattcattattttacataacggcgaagtgcgggcaagcggcacactggaagaactgagagagcagttcggcatgaaagacgcagctcttgatgacttgtatattgaactgacgaaggaagacgccggccatgaataatatgtctactatttggcagtcccggcttgaagagcatataaaggaaaccagaatgtatatgaaatatatgctcaatgatcatctcgtcattgtgctgatcttttttattgccggcgcggcgagctggtacagcaagtgggtcaaagacatccccgttcattttccctctttttgggtgatggcggtgctcttttcatttgtgctgaccggttcatacgtccggacgctgttaaaggaagcggacctcgtgtttctgctgccgcttgaaccgaaaatggggacatactttaagcattcatttaagtacagctatctgtcacagctgtttccgcttattgctctgtctcttgtatgcatgcctctgtttttcgctgtaagtccgggggcgtcgcttgcgtcgtatgccgccgtatttattcagatgctggcggtaaaagcgtggaatcaggccatggagtggcggatgacgtttatgaatgacagaagcatgaaaatgatggatgcggtcatacgctttatctgcaatatgctgcttttatacttcgtcttacagtcgttttatgtgtacgctgccgccgtctacattgtgatggccggcctttatgtgtatttcacatcagccgcaaaacataaatcattaaaatgggaagctcatattgaatatgaattaagaaggaagcagcggttttacagaatcgccaatctgtttaccgatgtgcctcacctgaaaaaacaggcaaaacgccgggcgtatctcgactttttgctcagaatgattccgtttgagcagcggaaaacgttctcctatatgtatgcgcgggcctttctgcgttcaaatgattatctcggcattcaggtcaggctcacgattatttttatcctgattattatgctcgtttccgccaatccgtggatcacggcggcgttaaccgtatttaccgtctttattacgggaatacagcttcttccgctgttcgggcattttcatcatctttctctgcaggagctttacccggtcaatcagaaagcgaagctgcaaagtttcttttcgctgatgaaatcgtcattaaccgtgcaggcgctgctgttctgcgcagcgtcagcctatgccgcgggagtcagcggggtgctgtatgcggccgttgcttcagccgttctgatttttgtgatcatgccatcgtatatgggcggaagattgaaaaagtacggcaagctgtaatcaatcgggtttttgaaacctcaatgaaagaaggagacacagatgaccgacgatcagcagctggtacaggaagcactgcaatggaaagcgcgttttttgcgcaaagattccatgcttgaacgcttttctaaaggaatgcaggcgaaaataaatgagcggattcccgaaaaaattcatgccgtcatcacagaaagcattaaaaaaatgaccgaagcaacaatggcgggttcaaatctggtgaaaagcaagcgggatacaaacggtatgacgcttgctgaaaaagatgctctcgccagacaaaccatcgcatcgtaccaaaaggtcgcggcagctgaaggtatcggtacgggggccggcggaatttttttaggaatggctgattttcctttgctgctatccattaaaatgaaatgtctgttcgatcttgcctccatttacggctatgatgtgaaagacagggatgagcgattgtttttgctgtttatttttcagctggctttctcaagcggtgaacagcggaaacgcatatactcaatgattgaacagtgggattcgaaaaagcatgatgtcgattggagagtttttcagcaggaataccgcgattatctggacgtggtcaaattgtttcagcttttgccggtcgtcggagccgccgtgggcggagcggccaattataaactgctgtcacagctcggtgagacggcaaggcacgtttttcatttaagaattacaacagccggtacgtaatgtaccggctgttttttttatgtcagcgggggtagcttaccgcggcgccgataagcaccttggcggccgtcagcatcgctttttcattaaaatcaaatttcgggtggtgatgaggataaacggtttccgcattttctaaagcggcgcccgtaaagaaaaaagcgccttttgtatgctgcagataataggaaaaatcctctcccgccatctgcggctctccttcaacgactttcgtaacgccgtctgtttccgctgcggctgccgccgcgtgcgccgcttcctcaggatgattgacgacggcgggatagccgcgtttgaaacgatattcataggaagcggagtgcatggaacagattccttttacgacggcttctatttctgcttcgagcaggccgcgcacactttcgtcaaacgagcggacggtgcctgaaatgactgcctgatcggcaatcgcattaaacggattttcagcggtgaacgagcctgctgagatgacggccggctgcaccggatttacccgccggctgacgatatgctgaagagccgtgacgatttgtgagccgattaaaacggcgtccttcgtatcgtgagggatcgcaccgtgaccgcctttgccgatgactttaatcgtaaagccgtcagcggcggccattactgggcccgggcggcataagaccgttccgacgggttcagtcgcccataggtgtgtgccgaaaatggcatcgacatgttcgaggcagccgtcctcaatcattgcttttgctccgccgggagataattcctcagcgtgctggtggatcatcacaaatgaccctttcagtttttcccggttgcggtacagcacttttccggccgcgagcagagccgccgtatggccgtcatgcccgcaggcgtgcatgacgccgggaatttgtgaagcatagggcacatctttttcatcctgtatcggcaaagcgtcaaaatcagctctgagtgccacgaccggtcccggttcaccgccttcaatacaggctgtgacaccgttgcccccgacattcgtccggatggggacgccgagcttttcataaaatgaggcgatgaacgccggtgtttttttctccttaaaggatggctcgggattcatgtgaaggtgacgcctgatttcaaccatttcctcatacagcccgtcaagctgagcgtttaagcttttttgaagtgtcgttaacgtcaaaagcgatgccccctcgtctgcttttcccatgattgtatagaaaatgtcagaagatttcaatctttttgctacgggagaatgatgatggcggcgatggtcgtgacgataagtccggccgcaacagggataaagtttttcctggcaagctcaaacgggtcaactttacaaatagccgcagcgggaatcagtgcccaagggaccaatgttccgcccccgacccagatcgctgaaatctggcccagcgccgttaaaacggccgggtccgtatgaagcgcggcagaaaacagctttgccatcgagcctgcaagagatataccggaaaaccctgacccgtcgagcccggtaatcgcaccgactgcggccagggcgatgccggcgaattctccggacatcggaaaagaatgggacagggccagtccgaggtcattgacgattcccgcagaccctttcggcagcggggtgttcaaaatatttttaaaccccgcgtcaccgagataaaagaaggccgcgatcggaatgacggggccgaatactttaaagccgaattgaaaaccgccgataaaatactcggtgatcttttctaaatgccgctctttatatacaatgaaatgaatgatcaggagaatgccgatcgcggttcctccgacgagtgccgtcgcatcgtttccttggaggcggtatacgatcatgcagataatatcggcgagaaaaacaagcggaatgaaaaccgccaggatcaccctgagttttttcggcagatacatacttgtgtccaaagaaccggagctgtccaaggagaggggggccttcgttttttttcgatcccgcatgatgaggaagaaagcggtgattgtcgtcgttaaccccatgatcaaaacgagcggaatacttgcctgcatgacatcgctcactgggatgcccgcggcatcggccgttaatttcggggccgcctgaatgacgtaatcccccgataaagcgaatccgtggccgaacaggttcatcgccatagccgcagcgatcggagaaaggcccgcccggatcgctgcgggaagcagcacagcgccgatcagcgccaccccgggtgacggccagaaaaaaagagagatggcaaacatcagacagccgataacccaatacgcgacagccggccctttcatcagctttgcaaacggagaaatcatcgcttcattaataccggttttggtcaaaaggccgctcatcgccacgataaaacaaatgataaaaatcgtcggcagcaattctccggcggcatacgtaaagctgtgaaacaggctgctgaccgaagcggagaatgaatgcgtcgtccatagcgcaatcacaaaaatgccggcgagtgaaataaaggttgtatcttttctgagaagcataaaaacgataatggccgcgataaaagcaacataaagcagatgtaccgagtagacgccgatccccaattgaaccactccgtttataaataggattgctacagggtattcataggcgggcggaaggtgcaaagaaggatgcgtaaaatcgggacatcaaaaaagccggagaatctccggcggttttcagtctattgcgtaataagcggttacataagacggacgggaaaaaatagacgtcgtgtcgataccggcagatgttccgcgttttttatgagcttcctgataagagtttgactgctgccaatcctgaaaggctttttcctcttcccacagggtcaaaatgacatacgtatcgccttcgagcggtcttaatacgcggatggctttaaaaccgggttcattttccactttgccggcgcggtttttaaaccggttttcaaacagcggacggccttcctgggtaacggcgatgttgttgaggacggcgtagcccggatttttgatttccccgacgctgtcgatgctttcataggaatggggcgcctgaaaaacggtttctccatttgtttcatgaattaaaaccgcattatcctccccttgcatcagcaccatattctcactcgggtgtttcttggcaatcgtctttaaaaaatcggctgtcccgtatgtaatataaaccttcatatcagccacctcctgcttgctagtatatcaaaagagtggtataagtttctattggcgactcattctgacataattcgaaacaatatttcccatactacaagttaagaaaggcgaggtgacttatgctgaaaaagaaaaaaagattctttattccggctgtaattgcggcggcaaccgcttttctcgcgttaatcggatacattatcattatatttctcggccattatgtcatcgatgaaaagaaattaatactgcacgcatcttcaaaaatcgtcgatcaaaacggtgatgaaatcgcgagcctctatacggaaaatcgtgagccggtatccattcagcaggttccggaagatgtgagagatgcctttatcgccgttgaagataaacggttttacgaacatcacggcattgatgtgaagtctgtcggacgggcggtgttccgggatgttttagcaggcggcaaggtggagggcggaagcacgatcacccagcagctggcgaaaaacatttttctgactcatgataaaacatttttgcgcaagacgaaggaagtcattatcgccatcaatcttgagcgtgattacagcaaggacaagctgcttgaaatgtacctgaaccagctttatttcggccatggcgtttacggcattcaagccgcgtcccactactactttaataaagaagtaaaagatttaaccgttgcagaaggagccgttctggcagcgattccgaaggcgccatctctttattcgccgattcagcatccggataaaaataaagaacggcgcgatacgattcttgcaatgatgaacgatcaaggctatatcagcgccaaggaagccgtcagagcccagggccggacattggggcttaatgtcaagaaaacatcagaaacgccttggtttgacagttatatcgatcttgtcatcaaggaggcggaagaccgttattcgatgtcaggagaacagctgcttcaaggcggttatacgatccggacgtcacttgattccaagctgcagaaaacggcatataccctcatgaaggaaagcggctattttccggggacggatcaggcggcagagggaagcgccgtctttattgataataaaaccggaggcgtgcgcgcggcggtcggcgggcgcgactacgtgacaaaaggatacaacagggttacggcgaagcggcagccgggctcaacgtttaagccgattgccgtatacgggcccgccatgcaggaagacaagttcaaaccgtattcgcttctccaagacaaactgacgtcctacgacgggtatgaaccgaaaaattatgacggacagtacaagggggaagtgacgatgcaggatgcgatcacttacagcataaatgcgcccgctgtctggacattgaagcagatcggcgtggatatgggaaaatcgtatcttgagaaaaacggcatgaacatttctgacaacggactcgcgattgcgctgggcggtctgtctgaaggcgtcactccgcttcagcttgccggagcttatcatacctttgcggcaaacggaatgtatacgaagccattttttatagagaacatcacggacgaagacggagaaacgttatccgggcctaaaaacggcaaaacgcgcgtcttcagcggacagacggcatggaatatgacgagaatgcttcagcaggtcgtaaaagaaggaaccgcttcacaaggcagctatcaaggtgacctggcggggaaaaccggcacgaccacatttaccggcatccccggcgcgacaaaggacgcctggtttgcgggatacactcccggactgacaggagccgtctggatgggctatgacaaaacggataaaacccattatctgaaaggcggcagccaatacccggtcagactctttaaagatatcgtcacaaaagcgggggaaaacggccggacattcaaaaagcctgaaaatgtgaaggaactgggcagcccgattgagctggaggcggtaaaatccctgtcggcccgttatacatttaaggcgatgggactgattacggttcaattaaaatgggatattcaaaaggatgatcgggttgtttaccgaatatatgagaagaaagacggaaaagacaagcttctggattcggtgaaaggaaaaggcagctttgacataccgtacgccaatctgttttcaggggcttcatacaaagtcgttccatttaattcgcagacgaatcaagaaggagagggaacggaatacgttcagccgaagcttttttcttcttaatcatgaattcggcgattttttgaacattaagcctcaattctataccattcagaaaaaacaaggtatagtgtaatgggcgaagaacacgaacgtatggttgcaggaggaaaggtggaaattcagatgagtaaacgagaagcgtttaatgatacgtttttaaaagcggcacggggagaaaaaacaaatcacgtccctgtctggtacatgagacaggcggggaggtctcagccggaataccgcaagctgaaagaaaagtacggcttagtcgaaattacgcatcagcccgagctgtgcgcgtatgtgacgaggctcccggtcgagcagtacggagtggacgctgccattttatataaagatattatgacgcctcttccttatatcggagtggatgttgaaataaaaaacggaatcggcccggtgatcgatcagccggtgcgctctgctgcggatattgaaaagctcggcgaactgaatcccgaacaggatgttccttacgtgctggaaacgatccgattactcgtaaacgaacagctgaatgttccgctcatcggtttttcgggagcgccttttacgctggccagttatatgattgaaggcgggccttctaaaaattacaacaaaacaaaagcgtttatgcacagtatgccgcaagcgtggcaaatgctgatggacaagctcgcggacatgattatcgtttatgtaaaagcgcagattaatgccggcgcaaaagccattcagatttttgattcatgggtcggcgcgctgaaccgcgaagattaccggcagtttataaaaccggtgatggacagaatattccgggagctttcagcagagcaagttccgctgatcatgttcggcgtaggcgcaagccacctggccggggattggcatgaccttcctcttgatgtcgtcggtcttgattggagactcggcatagatgacgccagaaaacaaggcattacaaaaacggttcagggcaatcttgatccgtcgcttcttcttgcgccttgggaagtcatcgagaaaaaagcgaaagcgatacttgatcaaggcatgaaaacggacgggtttattttcaatttagggcacggcgtattccctgatgtcaatccggcaacgctgaaaaagctgacggcgtttgtacatgaatattccgcggccaaaaaaacggaacaatcttcctgagcagatcgttggttataagaagattttcctgtcaaaatcaaggtagacagaccatcaaaagaggtgtttaacaaaatgagcagcaaaaagaaaatgggacttctcgtcatggcttacggaacgccttacaaagaagaagacatagaacgttattatacacatatcagacgcggaagaaagccggagccgcacatgcttcaagacttaaaagacagatatgaagcgatcggaggcatttctccgctggcaaaaatcacgcaggagcaggcggagaagctcgcacagcgtttaaatgaaatccaggacgacgtaacattcaaagtgtacatcggattaaaacatattgaaccgtttattgaagacgcggtggcggacatgcataaagacggccttacagaagctgtcagccttgtgctcgcccctcatttttcaacattcagcgtccagtcatacaacaaacgcgcgaaagaagaagcggagaagctcggcggcttgaccatcaagtctgttgaaagctggtatgatgaaccgaaattcgttgattattgggtcggccaggtgaagaaaacgtatgaatcaatgccgaaagaagaacgggatgacgcgatgctgatcgtctcagcgcacagccttcctgaaaaaattaaagaatacggcgatccgtatcctgaccagctggaggaatccgcaaaactgattgccgaaggcgccggaattaccgattacgcagtcggctggcaaagcgaagggaacacccctgatccgtggctcgggccggatgtgcaggatctcacgcgcgagctgtatcaaaagcatccttataaagcatttgtatacgtgcccgcaggcttcgttgccgatcatttagaggtgctttacgataatgattatgaatgcaaagctgtgaccgaagaagtcggcgcaagctactatcgtccggccatgccgaacgcacagcctgaatttatcgacgcgcttgcagcggtcgtgctgaaagagctggacaagtagaattaaacggtaaagaaggcgataaaaatgagtggcgataaaaaacatctggtcatcatcggcggcggcataacgggactagccgccgccttctacatggaaaaagaaatcaaggaaaaacagctgccgcttgaggtcaccctgatcgaagcgggcccgagagcgggcggcaaaattcagacggcgcataaagacggctacatcattgagcgggggccggattcttttttagaaaggaaaaaaagcgcgccgcagctcgttaaggatttggggcttgagcatctgctcgtcaacaatgcgaccggccagtcttacgtgctcgtcaatgagacgcttcatccgatgccgaagggcgcggtgatgggcattccgaccaaaatcgctccgttcatctccaccggtttattttctgtacccggaaaagcgcgggcggcgcttgactttgtcctgcctgcgagcaaaccgaaggaagatcagtctctgggtgaatttttccgcagacgcgtcggtgacgaagtcgttgagaatttaatagaaccgctattatcagggatttatgccggagatattgataagctgagcctcatgtccacgtttccgcaattctatcagactgagcaaaagcacagaagcctgattctcggtatgaaaaaatcacgtccgcagccttcgggacagcagctgacggccaaaaagcagggccagtttttaacggtgacgacaggacttcaaacgttggtggaggagctggaaaagcagcttacgctgacaaaggtgatgaaaggaacgaaagtcacccatatcggccgcgaggagaaaggatattccgtgacgcttgataatggcaaagtgctctatgcggaaggatgcatagtgacagcccgcataaagccgcggcgaaaatgctttctgatctgccggcggtttcatgtctcaaagatatgcattctacgtccgttgccaacgtcgccttaggttttcctgagggagccgtcaaaatggagcatgaaggtacgggattcgttatctcaagaaacagcgatttctccatcacggcctgcacatggacgaataaaaaatggccgcacgcggcgccggagggcaaaacacttctcagggcgtacgtcggaaaggccggagatgaatccatcgtagatctttcagataacgagatcattaaaatcgtaatggaagatttgaaaaaagtaatgaaaataaatggcgaaccggaaatgacctgtgtgacccgctggaacgaaagcatgccgcaataccatgtcggccataaggagcgcatcaaagagttcagagatgcgctgaaagcttcctatccgggcgtatacgcgacgggcgcgtctttcgaaggggtgggcatccccgactgtatcgaccagggaaaagccgccgtatatgattcactcgcttatttatttgaaacgtaccagcctccgttatcgtaaaacggaggttttttgcatgttcccgttctgtaaagggaacaccaataaagagaaaaaacatttgaatcttctttgcgactgtgataagttatcttatgtacaaaatgactaaaacgttcaaacggtcaatttaacgaggtgggaaacatgtccgtcgatcggaaaaagctcattctggaagcggcaacgaagtcttttacacaattcggctacaaagcaacgacaatggatctggtggcaaagcttgcaaatgtggggaagggaaccatctacacgtttttcaaaaacaaagaagaactgtttgatgatattttcaccactattttaagagaaatgaaggaacacgcagacgaagcgatgaaaccggagctttcatttcacgaaaatgttcaccgggcgcttgtcgcgattttggaattcagaaaaacacaccagctgactattaaaatttttcaggagaacgccgagattggtacaatagccgttcaggatgtcattgcgaaaatggagcgggccattctgtcatacattaaagaaaagatagaaacagccattgaaaacggaagcattaaaccgtgtgatccggaactgaccgcttttgtgatgctcaagctctacatcgcgctgatatttgactgggaaaaaaaccatccgcctcttgaaaaagagacgatcgccgaattgctggaaatgtatgttggtcaaggattatctaaataatagatgatccttcactttttaggtgccgtgaccgttttgtcaaatgagtcagtttgcggaaggaggcaacagggttgaatacaataaaaagccagtggaaagacattgtaacgaacaagaaactgttaatccccatcattgccatattattcgttccgctgatctacagcggagtgtttttgaaggcgtactgggacccgtacggcacggtggatcagctgccggttgtcgttgtcaaccaggataaaggggcggactacgaagggaaacatcttcagatcggtgacgatcttgtgaaagagttaaagaaaaatgataattttgattggcatttttcaaacgatcttgatcaatcgttaaaggacttattaaatgctaaatattatttattggtcgagattcctgaagatttttctaaaaacgccagcacggtaatggataaaaatccgaagaagctggatctgaaatatcatacgaatgccggatcaaactatgtcggcgcgacaatcggcgaaaaggcgatcgacaagctgaaagcctccgtgtcgaaagaagtgacggagcaatacgcaaaagtcatttttgacaattttaaagatattgccaaaggactcggcaaagccagcagcggcgccaagaaaatagacgacggcacgaaaaacgcgaaagacggcagcgccaagctgaaggaaaatttagcgaagcttactgaaagcaccgccaccatcggcgataaaacgcagcagcttgcagacggagcggcgaaagtgacaagcggaattcaaacgcttgacagctctatcgcaaaacttcagagcgcaagcgccgaaattcaagataaatcagggcagattgcttcaggaggaggccaagtggccagcgggctgaaaacgagccttgacgcacaaaagcagctccagcaaaagcttccggatttaacgaatggattaagcgcgttaaacagcaaggcgcaggaagtgtcgcaaaaagcggcggcatttgaagatgcgatcaattcagtcaacctctcagatattgaaaaagcggttggggagcttgagcagactgaaaaggaattgcagcagtttaagaaaaagctttctgatctgaaaaacagcctggatgcccgggatgacgcggtcaaaaaggtgattaaggacagtgatttcttaacggatgagcaaaaagcgaaacttgttcagcttctgaatgagaagcttccgaaggccgaccttccggatttagacaatatcgtcagccagcttccgtccggcggagatatccagcttccggatatgtcagtcataaaaagcgcgctggcagatgtaaaagcgaaggctgatcagctgaaagcactgcctcagtccacatcgaaactgtataacggcgcggcggcggtacaagacgcgattaaccagctgacggctggaactgataaattgtacagcggagcgcagaccgtctttgaaagccaaaacaaattgacggccggtatcggcgaatacaacagcaagttcggacagctcaaatcaggatcagaagcgttagtgtcagggagcggccaggtgtctggcggcttaacgaaactgctggacgcgcaaaacaaaatccatgacggctcgtccaaaattgagcagggtcaagcgtctctcggcaccggtttaagcaagcttttagacggcaccggacaattgtccagccagctgaaagatgcggctgatcaaaccggggacattaagacagatgacaaaacgtacagcatgtttgccgatccggtaaaaacggacgataacgcgattcattccgtgcctaactacggtaccggactgacgccttatattctctctatgggcttgtatgtcggcggattgatgctgacggtcgtattccctctgagtgaagcttcagggcgtccgagaaacggttttgaatggttcctcagcaaattcagcgtcattctgctcgtcggactgattcaatccgttatagtcgccacggttctgttaaaaggaatcgggcttgatgtggaaagcacttggagattctatctctttacgatgattaccagcatcgcgttcctgtcgatgattcaattattggcgacaacgatgggaaatccgggacgctttatcgctgtcatcattctggtgctccagcttggggcaagcggaggaaccttcccgcttgaactcctgccgggattctatcaagtgattcacggggcactgccgatgacttacagcatcaacgggttccgtgccgtcatttcaaatggcgattacggctatatgtggcagcaggcatccattctgttgggcatcgccgttgtcatgatcgcgctgaccatcgtgtattttacggtgcaaagcaaaaaagaacacaaaacggaagaagaaataacagcataagaaaaagaggcgctgagcagatgctcagggcctcttttttttgatttcgattaaaatccccatctcaccaaaagtccggtatacgtcaatccgccgccgaatccgaacaataccagcgtctggccttccgacagtttttttgctttcacagcttcatccaaagcgagaataatagaaaccgatgaagtgttgccgtaatattcaacgcttgtcaatgtccgttcaagcgggaagggcagtttttcacagatggattcgatcatccgcatgttggcgctgtgaggaacgaaccaatccagatcgtcttttgaaaagccggctttttctaaaagggcattgcattcctcaggcacggttctggccgcccatttatatacttcgcgcccgttttgcaccatatttcctccgcctttaagcggctcgccgtttaattctgcgctcagtcccgtgcgatacagcacgtccgcgcttcctcccgctgttccttgcacggctgccaaaaagcccggcgctgattcgtcgcgttccaccaatagggcgcctgcagcatctccgaaaagaacgcaggtcgtccggtcagtataatccgttacctttgataatgtttcaccggcaatgacaatcactttttgatgggaaccggcggtaattaatgcgtctgcgagctgaaggccgtaagtgagtccggcgcatgtggcgttaatatcaagcgctcccgtgtgcggccagccgaagtaagcctgcacgcgtgccgcggtgcttggaaacgcatagtccgccgtcgttgtggcgacaagaatcatatcgacatcatcaagagttccgctgtatcgttctgcaaggtttttcaccgcttccacacacaaatccgatgtgaattcatgttcgccggcaatgcgtctttccttcataccggtgcgctggacgatccattcatcagatgtatcgacgatgcgctctaaatccgcgtttgttaatcggcgtgccggagcatatgtaccgattgctgtaattttagattttgacatgaaaaaatcactcctttatatcagattataacacctgatattattacttggtactaattttaataaaaaaacccaagcagcatccgctgtttggggagcatgagaattttatttgtaaaacgggcttgtgtgaacgattaccaatgacggcagcagcggcggcatgaatgatgatgcttctttttgtctttcttctttttgtctttcttctttttacaagggtcttcttttttctttttacagtgatctttttcttttttacagcaccagaaggctgcaccagaccaatcatcctcaaaccaatcctcaaaccaatcattatgaaaccttttccgcttgtgcggtttacggctgatcatacatttccctcctatgctcatgctcccttcattctatgaaaaaagagcaggaaaagattggacgggttatggatcaaaagagtatattttaagaagaataaaattgataggaggaatgacctgtggaaaatatgaaacatacgatggaactgattaaagaactggtgtcgattccgagtccgacgggcaatacatacgaggttgtcgcctatacagaaagtcttttaaaagaatggggcgtctcctcttacagaaaccgcaaaggcggtctttttgtcacaattcccggccgtgatgacaagaaacacagattgctgacggcgcatgtcgatacgctcggcgcgatggtaaaggaaataaagtcggacggccggctgaagattgacttgatcggcggcttccgatatcactcgattgaaggggaatattgcgagatccaaacttcttccggcaaaacctatacaggcaccatcttaatgcatcagacttcagtgcacgtctacaaggacgccggcaaggcagagcggaatcaggagaatatggaagtccgccttgatgagcctgtccggacgaaggaagagacgtccgatctcggcatcagggtcggcgatttcatctcatttgacccgcgcgtgcagattacgccgagcggctttattaagtcccggcatcttgatgacaaagcgagcgtggctctgctcttgaatttaatccgccgcatcacggaagagaaaatcgaacttccgtatacgacgcattttctgatttctaataatgaagaaatcggctacggcggcaattccaacattcctcctgagaccgtcgaatacttggctgttgatatgggagcgatcggcgacggccagtctacggatgaatataccgtctccatttgcgtgaaggatgcgagcggaccgtaccattatcagctcagaaaacatctggccgggcttgcggagcgctatggcattgattatcagcttgatatttatccgtattacggttctgatgcctcagcagccatccgttcgggccatgacatcgttcacgggctgatcggcccgggaattgacgcttcacacgcttttgaacgcacgcatgaattatcgcttcttaatacggcgaagcttttgcaccggtacgttctatcgccgatggcataaaaaaccctgcgcggaaatcattccgtgcagggttttcattttaacctgaaatggttgtgttttgttctgttttggcgaggctcatgaccttcgcgcctttaacgggatcatactggccttcccattttgacatcacaacggatgccagcgcgtttccggtcagattgacgaccgtgcgggccatgtccataatccggtcaacaccggcgatgaatgcaaggccttctgcaggaatgttgaatgcgcctaatgtcgcaagcaggacgacgaaagaagtcccgggcacggcagccattcctttggaagtgaccatcaagacaagcacaagggtaatctgctgccaaatggacaagtcaatgtggtatacctgagcgaggaataaagcggcgatagattggtacagcacagatccgtctaagttaaaggtatatccgatcggcacaacaaaggaaacaatacctttcggacagccgatcttctccattttttccataacgcgggggagtacggtttcggagcttgacgtactgaacgctaataaaatttcatccttcatataggcgaggaatttgaaaatgtttactccggcaagctttccgacgattccgaatacaacaatgagaaagaaagccaaagctacatacactaaaccgaccagtttaccgagtgaaagcagggaactgagcccaaatttggaaacggtaacaccaatcaacgcaaaaacaccaaacggcgcaactttcatgacgaggttcacaacatggaacatcgcatgagaaacaccttcaaagaaggccaagacaggctttcctttttcaccgattgccgagatgccgagtgcaaacagcacggtaaagcagatgatggcaagcagatctccttcggctaatgattggaagaagtttgtcggtacgatatgcaggaatgtgtctgcgatagatttgttattttgttctttttctgtttcaacatattgactgatatctgtcttttgagcttcatgtatattaacgcctgttcccggatgaaacagattcgccaaagccagcccgagaataatggcaaaagtggtaatgatctcaaaatacaaaatcgttttgaagcctaattttccgacttgttttccgcttcccgcgccggcaacgccgatgattaagctggagacgacaattggaatcactatcattttgattaagcgtaaaaacaaatcgccgataggctgtaaatatgttggaatggcgggattgccgtaccagatgacaccgactacaaccctagtatgagtccgacgaaaatttgcgtcgctagtccaaagcgtaattttttcatagattacctcccgaagaaaaaagtgcaataagtatctaaaaagatagctattagaacaaattataatagaaaagaaaacaatccgtctatagaaaaatatagattgaaaatactgaatcttttaaaacgtacagataattgctaataatggtgaataacgccctattcagaaagtatgatgacggccgaaaaaacgggcgccgcacaacttagaattgtgcggcgccctattgtcacatatccttaattttcaagcagtcattgcacagattaatgtgacactcatactgctcaacaatctcatttccgcattcttcgcatttcttaccgggtaaatttctgaaaaaatccgacatcttttccaacatacccatccctctttcattgttttgtctctacattgtattataacagttttggaaaatcaacggctgttttggcacaatgtttaaaacatgcaatttgtacgaaaaataggtatattggaggaaaggatctttttatcataaacattcggagggtcatatgaaagttacagttattggatgctgcggcgggtttccggccgcaaacgaagcaacttcaggctatctgtttcagtccggcggctattctctgctcgtcgattgcggaagcgccgtattatcaaagctgtttgcctatgttccggcagaagagcttgatgccgtcattttgtcccattatcaccatgatcacatcgctgatatcgggccgcttcaatttgccaaacaggtcggctcctttctcggaaaagggacgcatgcactgccgatttacgggcatgatgctgatatagaacagtttgagcgtcttacatataaaacgcatacgaaaggagtggcctatcagccggaccgcccgctttctgccgggccgttcaccattaccttcctgaaaacggtgcatccggtcacttgttatgcgatgcggattactgacggttcagcttctgttgtgtatacggctgattcaagctaccaggacgcgtttatcccgtttgcggaaaatgccgatctgctgatctgcgagtgcaatttttacgcggaccaggacggcacgtcagccggccatatgaacagtttggaagccggacgtatcgcggaggaggccggagcgggggagctgattctcacacatctgcctcatttcggcgagcaccggaagctgaaagaagaagcggaatccgtgttcgggggcgaagtgacaatcgccgcttccggattgaagtgggagaaataaaggaggagcaccatgttatttatcgacaaccaaaacataaccgacccgaggatcaacctcgcaatcgaggaatattgcgtgaagcatctcgaccctgaacagacatacctgctgttttatgtcaatcagccgtcgattatcatcgggaagaaccaaaacacaatagaagaaatcaatacgaaatacgtagaagataacggaatcatcgtcgtccgcaggctgtcaggaggcggcgcggtttaccatgacctcgggaatctgaatttcagttttatcaccaaggatgacggcgacagcttccacaattttaaaaaattcaccgaacccgttattcaggcgctgcgccagctcggtgtggaagctgaattaagcggccgaaacgacatcgtcgcggacggcagaaaaatttccggcaacgctcaattttcgacgaaagggcgtattttcagccacggaacattaatgctggattccgccattgatcatgtcgtgtcagccttaaaagtgaaaaaagacaaaattgaatcaaaaggcattaagtcaatcagaagccgtgtcgccaacatcagcgagtttcttgatgacaaaatgacggcggacgaattcaaaaaacatctgcttcaccatatttttaatacaaatgatctttccgaagtgccggaatataaactgaccgatgaagactggaaagcgatccggaagatttccgaagagcgctatcaaaactgggactggaatttcggaaggtcgcccgcattcaaccttcagcattcgaaacgttatccggtcggatcgattgatctgcgtcttgaagtgaaaaaaggaatcattcaggactgcaaaattttcggtgatttcttcggtgcgaaagatgtgagtgaagtcgaacaggcgctgaccggaaaacagtatgacagaaccgctatcagggaggcgctggccggaatcgatctgaaacagtatttcggcaaaatagagctggaagatttcctcgagctgatttattagaacatttgccgaacgcatgatttgaatctgcgcccgtttttgtgaaatgatagaaccataatgaatggggagggatcatgatgaaagtatttctcatcggagcaaacgggcagatcggacagcgtctgaccgggctgtttcaaaaagacggcacgcatacgctgcgggcgatggtccggaaagaagagcagaaagaagcgcttcaagccgcgggaacagaagccgttcttgcagatttggaaggaagcacggaagacatcgcgaaagccgctgaaggctgtgacgcgattgtgtttaccgccggatcaggaggaagcaccggatacgataagacgcttctgattgatcttgacggagcggcgaaagcgatagaagcggcaaagaaggccggcatcaagcggttcattatggtaagcgcccttcaggctcataaccgcgacaattggaatgaagcgctgaagccgtattatgccgcaaagcattatgcggataaaattcttgaagcgagcggtctgacgtatacgattatccggccgggcgggttattaaatgatcccggcacgggaaatatcaaagccgcagccgatttagaaagaggctccatttcaagagacgatgtcgccaagaccgttatcgcatcccttgatgaaccgaatacgtatgaaaaagcgttcgatctgacagcgggcggcacgccggtcagtgaagcgctgaaacaattatagtttccggttttacggcactcggggctttttgcccttgagtgtttttctatatttttctataataaaagtgaacgtttattccggataaatgaatgactattcattcattatatttttaaaggggtgggaaaatgaatctggtttccaaattggaagaaacggcatcgcagaaaccggaaaaaccagcttgtctgtttcaagatcagtacatgacgtatgaggagctggcaggtaaaatcaaagcatttgcaaacggcttggaggacaggggactgaaaaaaggggatcatctcgcgctgctgctcggaaatacgcctgattttgttattgcgtttttcggcgcgttaaaagcgggaattgtcgtcatacctgttaatccggcatacacaccttcagaaatcgcatacatgctgaaaaacggcgatgtcaaagcgatcgccggcatcgacctattaattcccgtatttgaaagcctgcacggctcgctgccgctgctggagcatatcattatcagccagacagcagagaacgctccatcgacagaagaccctcaattgcgcttaaaaatgacaacgtttacaaaaatgctccgcccggcggagcgcagcagaacttatccgacattgtccaaagacgatactgccgtcattttatacacctcagggacgaccggaaaaccgaaaggcgccatgctcacccatcagaatcttttctccaatgcaaatgatgtcgccggatacttaggaatgaatgagaaagacaaaattgtggcggcattgccgatgtttcacgttttttgtttaaccgtttgtatgaatgcgcctctgatgagcggagcgtgtgtcttaatcgagccgcaattcagcccggcttctgtgtttaaactgattaaaagccgtcaggcaaccatttttgccggcgttccgacgatgtataactatctgtatcaatacgagcacggcaaggcggaggattttgcgtccgtcagactgtgcatttcaggcggggcctccatgccggtcgctctgttgcagacgtttgaacaaacctttgacgtcaccattctggagggatacggactttctgaagcgtctccggttacttgttttaatccgtttgaccgggggagaaagcccggctcgatcgggacgaatattttacatgtcgaaaataaagtcgtcgatacgctcggacgcgaattgcccgaccatcaagtgggagaattgatcgtgaaagggccgaatgtgatgaaaggctattacaagatgcccgaggagacggagcacgcgctgaaagacggctggctgtacacgggtgatttggcgaagcgcgacgaagacggttatttttatatcgtcgacagaaaaaaagatatgattctcgtcggcggatacaatgtctatccgcgcgaagtagaagaagtgctctacagccatgagggcattaaagaagccgtggtcatcggcgttcctgacgccaaaacgggggaagcggtgcatgcttatatagtgcctgcggacggtgagctgacagagcaggcggttttcgattactgtgaaacacatttggcaaaatataagcggccggcggaagtggtttttcttgatgagattccgaagaacgcgaccgggaagctgctgagaagggcggtccgggacatgcttccgaaatgacggacgaaaagcgaagccgggggcttcgcttttacatgctgatccggtcagctgtgcgattcttccttaatgatgctttgcacaagcttcgtatcatgccgggtcagtttgtaatacgtgtttttatgcttgtacatcatataattgccgctttcgagccacatactgaatgaatcaaaacggtcttcatggtatttgaccgttccgtcgtaatcgggagacacgcttttggtcagtttgacttgttttccttggttcaagatatcgagcatatcttttacattctgcctgtctttaattttgatttctttttttccgttctctgacagaataatcagatctgcgttgcttgatggaaacacatcgccggtccggctgtatacatagaagaaagcaataaccaaaagggcgattactacaataaacgcgattatttttttcatattcatcactccgtcttttagtctttcccgcttcctgttgttccattcttttctgttgtgaaaagattaacatccgtttcggaggcttggttctatttatttgcatttatgcttacaataggagtaagtcataaggctaaggagggagacttccatgcgcaaatggatagcggcagcgggacttgcctatgtgctgtacggcctttttttctattggtatttctttatgacaggagactccgccgtcccggaggccgtaaagggaacgaaagccgatccgtcctcgttcatggacccgggccgcctggcagccgctgaaaacttttcaaatgtaaaggattttttatttttcatcggagcgccgttagattggtttttattttttctgctgctcattacggggcttgcaaaaaaaataaagcattggctggaagcagcggtgcgctttcgggtgctgcaaatcgtaagcttcgtatttgtgatttcactcatcgttacggcggcttcgcttccgcttgagtggatcggatatcgggtttcgcttgcgtatcatatttcgacgcagacagcagcaagctggataagagaccatgtcattgatttctggatcagttttccgctgtttgccgtgtgtgtgcttgtgttttactggctgatcacaaagcatacaaaaaaatggtggttttacgcttggtgtcttactgtgccgtttaccctgtttttgtttttcctgcagccggtcgtgattgatcctttatacaatgatttctatccgctgaaagacaaggagctggaaagcaaaattttgtcgcttgccgacaaggccgacattccggccagccatgtgtatgaagtaaatatgtcggagaaaacgaatgcgctgaatgcgtatgtgacgggcatcggttcgaataagcggatcgttttgtgggatacgacgcttaacaaactgaaggatcgggaaattttgttcattatggggcatgagatggggcactatgtgatgaagcacgtgtacatcggactggccgggtatctgctgctgtcattagccgggttttatatcattgacaagctttataagcggctgtccaaattcttcggccgaatgcttcatataaaggggcctgaagatctggccgccctcccgctgttattgctgctcatatccgttctcagttttgcttctgatccgattacgaacgccgtctcccggtatcaggaaaacgccgccgaccgttacggcatcgagctgaccggaaaccgggaagcggcgattgagacgtttcaggacttggccgatacgggactgagccgggtcaacccgccgtttctcgtcaaaattttcagagggagccacccgtcgatcatggagcggattgaacatgcggaggaagaaaaataataaaaaaaccggcggggccatggccgacgccggttttttatgttttactgagctgccgcctgtacgttgatcagcccttttccatagtagaaagcatcaccaagttttgtagtggtgttttctaaactgctgcggacttgagtgtttgtccagttcgggtgcttagaaagaatcaaagcagccgctccggcaacgtgcggagatgccattgacgtaccattgtacgctccgtatttgtttccaggaagcgtgctttggatagagacgcctggtgccatgacatcaagctcagaacctacgcttgagaaagatgctctttggttgctgctgttaacagcgcctaccgcaatgacagaagggtatttaccagggtagcccactgtgcttgagccgccggaagtgccttcgttaccggctgccgcaaccactacgacgccggaagcaacggctttgtcaactgccgcttttaacgctgcagaaccagaaggtccgccgaggctcatgttaataacgtccatattgtttgcgatcgcccactcaattccgttaatgatccagctgtactggccggaaccgtcagcgccgagaacttttacagcgtaaagagatgcgcttggcgcaacgcctaatacaccgactgagttattaagagctgcaactgtaccggcaacgtgagttccgtgagagttgttatcttggaaaggatttgtttcagaaggaaccatgctggctccgcctgctacctttaaatcaggatgagaagaatcgataccgctgtcgataaccgctactttaacatttgatccggtgaagccttgagagtgcagtgcaggggctttaatctgtgatacgccgtaaggcacggactgcgcgtacgcctgtgcaacgtgatcttcttcaacgtaagcgacgctagggtcttttttcagctcttttacagctttttcatttaatgtagctgaagctgcgtctacatatttgaattgcttttccactttcccgcctttttcagaaatgacatcttttttcttggcggcgctcatcgtgctcattgtctgcttaaatccgacaatatatttcttttccccgtttgatttccctgcagcctgggcagaagtcgtgctgccgaacgccatcgtaaagattaacgctaaagcaaacagcaaactgatccatacctttttgcctctcactctttatccactccttttttcatttgcagaataaccaatagacagattattctgtggattaattgtatagtatggaataatattttagtagacccaatttttttcagtttgttttatttctatttaggtatatcatctctctttcgtttaataggaacccgaaatatttaaattttaatggaaaaaaccgatggaaggacatgagtatttgtacacagccgcaatcgctctcttgtttactgggtcgaacggtttgattccatttttggaagctgaggcaaaaacaggataaatgtcaccttttgttgaatgcagaagtctgatggaaacgaaagcggaatgaaataaagcggccggcatgaatcagtctttgactttcttgagggagaaaagctgtgaaaccattttataaaaataatgataatgaatatcattgatacttatattgtcaatgatataattgcggaaaaacgaaagagcgggaacagatgaaaccaattttcagtatgctgatgatcttatccgttctcttcataacggcatgctcagaacaggaacatgaaaccgccgtcaggcatgatctggggacggcgcatgtggctgcgcacccgcagcgcatcgccgtattgaatgagggctttattgacaccctccatgatctcggtataaagccggcggccgcggcggataaccggaaagagcgaaacgacggcagtccgtccgtcgggcccccgtcacatcccgatttgaaaaaaatcacttcgttaaaacccgatctcatcattgcagactcaagcctgcacagggggatataccatgagctgacaaagatcgctccgacaatcgctttgaaaaatgaagctgcggattatcaggatgcggttgatgctgcccttaccattgaaaaggcggtcggtaaagagggcatcatagagaaacaattgtcggctcaggaagaaaagctgaatgacatcaaaagaaagctggatgcagaaggcggcacgattttattaattgacgctgcaaatggcagcatttccgtaaaggatgaccggtttttcacatcccggcttttgacgctcgcagggtttacatatgcggtccagacggattccggcgggaaatcagacgctatcaaaatgaggcccgggcagcttttgcatatcgatcctgattacatcgtactattggacggtgaggaagaactcgaaaaaaatcacctctggaaacagctgactgccgtaaaaaacggacacgtttaccgcgcggacagggcggtatggacggagcgccggagcattgacggtgcggacgccgtattacatgatcttcagaaaaaaatgctcgccaaaaaggcccaaaactaattcgggcctttttgttatgattctgataggtggctgcttacattgtaatctttgacgcgccacttattttcaattcgttcgatattgctcaggcacgcattgacaagctttgcgttttgtatgccggtatcaccgtcagaaatagcggacaagagggcgtgaatagctgcgccgtgagcgacgatcagtactttttgatcaggaaaccgctcctgaactttcactaaaccggcaagcattctgtctgtcagctcttctgcggtctccatgttcgggtagtttttatccgggtagcgcttcgaccgttccggcaaagacattccttccgcatcaccgtagctccgttctctgaaatcttccatgacgacaatgggaagattcaaaaacccgttaataatgtcagctgtttttctggcccgtttcatcgggctcgagacgatgacatcccattcggacccctttaagtactctcctgtttctttcgcctgacgctctcccgtcgcatttaacggaatatccgatttgccttgaagcttcttttgggcattccaatcagtctctccatgtcttactaaacaaacggcagtcataaagtctccactccgatcattttttatcgatatcatctattatactgccgttacgttaacacttcaaagagaagcgccagtccgactccgcctccgctgccgatcgctgctgctgcgtagcgggcatccgggcgtctttttgcttcataaaaaagccgggtgataagcgccgctccggaagccccgtacggatgcccgacggccagagcgccgccccggacatttattttagaatacggcacttgaagctgctgtgaaaaaacgcatattttgacggcaaacgcctcgttgatttcgtatatatcaatatcatccggtgacaggtcccgttccttcaaaagctttttgacggcataaaccggagctgctgacggataatgcggatggacgccgcttaccgcgcttccgataaaacgcaatcccggctttaaaccgagagaccgcgctttttgttcttccatcacacaaactgccgccgccccgtcagaaattccgcagctgttggccgcggtgacagagcctccggactgaaagacgggtttggcgcgggcgatgagaggccccatgttccgctttttcagcatgttttcgtcagcggcgaatccgtgacaggggagaatttcccggcggtacaagccgtcttcgtgcgctttgacgctccgttcatagctgagaagggcatattcatcctgcatctttctcgttacgccgtaagcctgtgccgtatactcggccgctatgcccatatcaggatcgccgatgtgttcaggagaaaagcgcgcccgggatgagaaaggggaacggctgctgctctccgctcctcccgcgatgtatgtgctccccgcgccggctttaacaaagtggcacgcgaccctcacggcgtccaatccggaaccgcactgcctgtcgatggtcgtaccggacacgctcaaaggaagcccggcggccaaggctgacagccgggcgaggttcccgccgcggcccgtcgcgtttccgatcaggacttcatcaatgtcttcgggcatgttccggctcaaatgtcggatcagcggagctgccaaatcttcggggagacagtcttttaacaggccgttttcccgggcgaaaatcgtccgcttcgcatccgtaattacagcttccattccatcatgtcctttgcctgcttttgtacggcggcacgggcgatctttccgccggctgtttccggtatttctgaaaacagccattttttcgggattttatatgccgccagctgctcgcggcactgtttcttcagttcctttacatttgcatgtccgtcgatcaccgcaacggcgatgctgccccaataatcatcaggaatgccgatgacggccgcttttctgacgcccggacagcggttgagcacacgttctatctcttccgggaatacattcaggccgcctgatacgatcatcccgttttcacgtccttcgatataaagatagccttcacgatcgatatatcccatgtcatcaaccgtcatccagccggaatcatcaggttttgcgccgttgatgtatccggaaaatttcatcgggctgttcacaaaaatcttccccgtttcgcccggcatgcagcgttccccgccgggccggcggatttcgattgtaacattttcaaacggacggcccgccgcgtcaggcttccgggcgctgtcttcaggcgataagaacgccacgaaactcagctcagacgttccgtaaaaatcgtacaaccgtaaatggggatagcgctctgacagcgcttgtttagacgaagcgggccagtctgcaccggaagaaatcaccttgagcggtgtatccggaaacgcctctagtgagagcagggcgtccgtcattgtcggaacggtatatagaacgtcagcttgtctgagccggtctttcattccggccggattgaattttctttgaaggaggacggttccgccgataaacaaagtgctgacggcgccgtataaaaagtgtgacgagcgaagcgtgcccggtaccagcactttgtcatcaggggaaatgccgaattcacgtttcgtacaagaaaagctctccagccacgaacggtgagagcgggtgaaggctttcggcttaccggtcgatcccgaggtgaatccggtataaaagggcaggccggtgtttttgataaaagtgccttccgttttttccgcctcgatcaaaggcccgcattcatcccacaggatgacaggcgttttgatgccgtccagtctgccgctcagccggcggtcacagatgacgaggtcggttttgctgatgtgcagctggtccgcgagttccgccgcagccgagcggggatctaacggaaccgccgtgcagccggcatgcgccgcccctgcgaaaagttgtaaaaatgggatgccgttcggcagtaatattgcaatgttttccggcttatctgaaaggctgccaagccagtttgcggtttggtttactagcctgttccaagtttgataggtgatctgttctgtgtctgtctgaattgcgatccgttccggcgcttgtccggctgtatctgaatatgatgatgtaatcatgatgactaaaatcagcttcctttcgtcggcaaaagccggcttgcttgaagagtttttctgattcttacggctgcgaatgaggctgcggccgctttaagcagatctccgggcacatagatgaggctgagctttacggcagtcaagatatcaatgtgcattataaaagcctgaacgggaatgccgatgacatacaaaaacagcacgccgaacaagaactgtctgataaacaaatgggggacagcagctgagcgaaggccttggatgctgaggctcagcagtaatgccgccagcggatatgcgatgagatatccggcgctcggcccgaaaaaaaccccgaacccgcctcttccgcctgaaaggagaggcgctccgcatgccacaatcagcaaaaaaagcaattggcttaaaaatgccgctttcggtttaaggatgcttcctgataagagcacaccgatcgtctggagcgtaatcggaaccggcgtaaaggataagaaaagcggcggaagcagccccaaaagtcccataatggcggtaaacacggcaatatgcatcatttctgtcaatttcattatgtattcctccagcttatcaaaatatgtttatacaataaagcgagtctttatatatgtcaactctattatattttaagttaacattaaaaagaccggccctttatgaaaaaggccggtcggtttatctttattcttctgtaaggataacaagtgaatcaacggatgatgcaacgtgggaaacggcgcggctgacttcttgaaggccgccgagaaaggcctgcaaatcaacgtcgattttgcctgtctggtctttgctcgttttcatgctttggacgatgtcatcaaacagacggttgatctgcgtcattttttctttcgtttcgcttacaagtccgtttacatctttaatatgtttggacacgatgttgatttgtgtattggtattgttcacgagctctgatacggtggaaacggtttttttcgtatcctctgaaagcttccttacctccgtcgcgacaacggcgaaccctttgccgtgctctccggctctggcggattctattgaagcgttgagtgacaggagattcgtttgctcggcgatccccgtcacgatgccgaagattttttcgatctgctgggcgatgtcattcagcttgtccatttcttcttcaatctgcagaaggctggcgtcgattttattcatctgctgctgctggctttcaagctcttttttcccgccgattgatttttcttcgacatgtacggaagtgacggtgccggcttttgacgcctcggaaatgccctcagatttatcgaccagctcctgcacggctctgctcgtttctgaaaacaaatcagcgagtgatccggatgtttcctggattttctgatgaagacgggctttcttttcctcttgttcgtcacgctggcagttatattcagtctggaatgcttcaaggacgagctgctgttcaagattcaatattttcgtcgtcgctttgatcgcttttaaaagctcatgcaaatccggaatggttgcttcatatatgttcatcatcgacagaagcagatcctgaaacgctcccatataccatttcggttcaaggccgatccgcaagtggatggaagcgatgcgctgtcttttttcaatgaattcatcatcaattgtgccggcgaacatctcatggatatgacgccgtaatgtttttttcaggcgctcgaccgtgctgtggtcgttaatgatcgtcattaatgatttttcgtgatccaggtttcggtaaaaggaatcgacgattgttgagatatgttctttaattaacggctgcagctcttcaagcacatgaagttcttcgtttccgagcctgaccattttcagctgtttttggacatctgcatattgatttgaaagcgcgatgcgtttttttccatcggcttctgaaaaatatgctgtttcttttttgcggtcttttttaaataacaatattagttcccccagatattctctttttctttttatcggtttggaaggaacttgaatgaaggaatctgataaaaatattttaatgcggaaaaaaataaaaccattcgtacagaatggtttagtcaatcttgggtgagacgtttcagcggcttgatggcgggaccttcggcaaccccgccgtcgggtgtgaaccgggacccgtgacatggacagtcccacgtccgttcgccgtcattccattcaacctcacagcctaaatgggtgcatgtcgtatcgacaagatgcagacagcctttttcatctttataggcgccggcccgtttgccgtttaccgttacgatttttccctcccgggcccaagactctcaggcgaagcgtccggcctctcaagtttgcccgagataaggtgtttggccacgtcggcattataggaaatcagttttttcagtccgggatctgcgtggaagcgtgacggaataaacaggccggaaaacgggttctttttgttttgaatatgatcagccaaaagcttcgcggcgagcgctgagcttgtcatgccccattttttaaaaccggtcgccgccaaaatatgttcttcatcgcctgagatcggaccgatgaacggaattttgtcaatggtgacaaggtcttgtgcagaccaatgatatgggatgctttcaactccgattgtgtcttccgcaaattgtttcagcgcttcgtaatgcccggacatttcttttccttggcctgttttgtggctttcaccgccgacaagcaccagtttttcaccgttcaaatcggtgtatcgcagtgatctggacggcttgtctatgctgagatacatcccgtccggatacgcttgtttcggttttaccgcgagtacgtaggatctgctggcatacattctggcggcataaagcccgcctccgtcataaaaaggaaagtgggaagcgcagacaatgtagctgcacttgatgccgtgtctgtttttcgtgaccacttccggctgcggttctttttttatgtcgatcgcagccgtctgttcaaaaatccgcgccccgtttttaacgatctctttgacgagcgccgcaccatataaaagcggatggaattgcgcctgattcttcatggcgaggccgagcctgcaatcaacggggacgggaagttctttcacaagctcgtgttcaataccgagcttggtataagcttcctgctcactgcgcatttttttgacgcctgattctgtattggtgtaaagatatgcgtcttgttcaatcagtctgcagtcaatcgaaaggtccttgatgatctgcttcatgtcttccatggcgcggagatgggcttcgaaatacagccttgcgctggtcaggccgatctgctgaataagatcggcatagatgaaatcatgctgggcggtgatttttgcggtcgtgcccgcggtcgtcccgtttaaaatccggtctgcttcaatgacagcgacacggaaacctcttttcgtcagttcgtatgccgttgtcaggcccgtaattcctccgccgatcaccgcaacgtcacattccgtatcttcagtgagggcgggaaaggaaggaatgtcagctgttgctttccaataggaagccggttcctcgtttgaaaaagtagtcaattcagatttacctcctctgttgtatattcttaatttttccaataagactctgttcatacatgaaattcgtataagatgctcaaattactcataatatagtaattaatgtaaaggagtgatcaaaatggcgaatcagaagaagaaaaccttgccgccgcagcatcaaaaccggcagccgggctttgaatatgtaatggacccgcgccccgtttttgacaaaccgaaagcggcgaaaaaacttgaagggaaaacggcgatcatcacgggcggagacagcgggatcggccgcgccgtatccgttttattcgcaaaggaaggcgctaatgtggtcatcgtttactttgatgagcatcaggatgccgaagagacgaagcaatatgtagaaaaagaaggggcgaagtgtctgctgatcgcaggggatgtcggcgacgaagccttttgcaacgatgtcatccgccaggcgggccaagcctttccttccattgacatcctggtcaacaacgcgggtgagcagcacgtgcagccggggattgagaaaatcacgagccaccagctcatcagaacgtttcagacgaatattttttcaatgttttacttgacgaaagccgcgctccctcacctgaaaagaggaagttcaatcattaatacggcctccattaccgcctataaaggccacaaaacattgattgactattcagcgacaaaaggggcgatcgtcacgtttacaagatctctttcccaatctcttgtcactcagggcatcagggtaaacgcagtggcgccggggccgatctggacgccgctgatcccggcgagcttctcggcgaaggaagtggaagtcttcggctcagacgtgccgatgcagcgcccgggagagcctgttgaagtggcgccgagctatttgtacttagcaagcgatgattcttcctatgtcacgggacagacgattcatgtgaacggcggcaccatcgtaaacggataatgtaaaaaaagccaatccatatggattggcttattcactctgtttgagagcggcatattcttttgaaagcgtgaggaacgcttctttatttttatcatcaagcgccttattaatctgcattgtcagcatggcgatccggcgtttatacaaggattcatcaagcaccatttgaatgtaaatatcggccattgtcacatcgaattcgtttgctttttccgtgttgcgggacttcatgagctcagtgtacgactttttctctttcataaagaatccccccaatgccttttttatagtatatggataacggccggaaaaatcaattaatttttataatctttagataactaatacttggaaatatatcgacatatcctgcaaattgacgaaaaaacgaaaatgatcattgtataaatgaggtgaaatgaaaaagaaaaataatatttaaatagtaatttaagactaaattacagctttaaaaggtgatttttagctatattcaaaaaaaacctgtcgttttccaattacagatgatagattattagtataaattttcaagaaaaggattggaggctgcacatcatgtgccagaaaacacacgcacccttagaaagctacgaagtaaatcgttcaaccatcgctgttttgcctgaggaaatagacggtaaaatggggtcgaaggtcattgaaaaagactgcattctgtatgtcagcatgaagccgattcacatcatcgacagaagctgccgctactttggctccagctatgccgggagaaaagcgggaacatatgaagcgattaaaatttctcacaagccgccgattatggtggacccttcaaatcacatctttttattccctacactttcttctgcaaggcctcaatgcggctggatatctcatgtgcacgttaaagattttcaaccgacggcatttgatgacacagcggtcacgttctcaaacggcaaaacgatggaactggaagtatcctatcattcttttgaaaatcaggtttacagaaccgcctatctcagaaccacttttcaggacaggatgggcagtcatatcccgaagcggcaggaattcatgctgtatccgaaagaagagcggacaagaatgatctacgactttattttgcgggagctgggggagagatattagagaaagctgtgatgtaaagggacgggccctttccttttgggaagggctttttcgatttacatgcccggatagagttgtatcgtgtccgtctgttggctatgatgatgtaaagagtaatgatatttcattttaggagagatgggcatggatgtgtttgcaaaatatgtatcagaaatcgataacccggatcaccgtctcaaagcagaggaaattttgtcgtggacggctgaccaatttccgaacttagaagcgcagatcaagtggaacaaaccgacatttaccgatcacggcacctatatcattatgtttgccgcggcaaaaaatcatttgagcattttacctgaaaaagagacgatggagcattttgccgatgacatcgcccaagccgggtacagcgcttcttcacgcctgttcagaattcggtggactgatccggtgcactatgatctgcttaagaagatcatcgaatttaacatcaaagaaaaagctgaaaatccggggttttggcgttagcggacgtgatgttgaaggaggaagacatggacgttttcaaagactatttatcaagtatcgacagccctgaccatcgtctgcgaatggaggaaatcctgtcgtggacgtctgagcaattcccgggtttaacaccgcagatcaagtggaacacgccgatgtttaccgatcacggcacctttattatcggctttgcggcagcaaagcatcatgtaagtgtttctcccgaagaagctggaattgcgcattttgccgacgacattgcccgtgccggctacagcgctacttcccgtttgttcagaattcaatggactgaaccggtgtattatgagctgcttgaacgcatgattcaatttaatatcaaggataaggcggactgctcagcgttttggcggaaataatgaaagaaatgttaaaaaaacaaccctgaggagggctgtttttttattaaacgtaatccgaaaaataagggatttgcgtatccggcagacccttacgaaacgcacgatgaaagaaatcgtgcgttcaaaattctttatttgacgacagacatgctgacggtgctgcctgacactgtcaatttggcaaaatcctgtgtatcaatcacaggtgtgactgctttattgtcgatcgtgatgttcgtaaaggctgtcgagaagtttgatttgatgtaagggcgctgatcctctgatgtgaccgcgacggtggcgagcgctttccattttgagacagagcctacattggtttgggcgagttctgagatgatgcggccggtgtatccgtcattattcgtgccccaatatgtggcgcgggtattgccgttcagatttttgtaaatggtcagctgtacggtgctgccgggccggaagcctttcgtataagtgaattggctttctccttccagataccggacctggccttgtccctttgaaccgactttcatgatcggtttccatacatgataggtgtcactgtactgaagcccgatatcagcctctgtgcctccggtaaatcctgagtaaatataggctgtcccatttgacacctgaatcgagcttggaagctgaattttcgtgacgagaactgagcccgtgctgttcagataggcccttccgccgattcctttactgagctgggacgccgcttccgccgtattgggactgatcaccccggaatatccgccgtacatgcgccgaatagaacggctgtagtgagaacacccgcaacaagcccttttttcatcatcatttctcctcctatcatcatagtcagatagcgctatcaattcatattataaaaggttttgggaaaaattccataaaagatatacgggcggacgtaaattaaaactattttcctatttatcttgtaaatggagattatttgaactatgatatgttcagtcatacaacatgattcaggaaaggggataggatagaaatgaaaaagacggcagctgtgcttttgtctttcggcctggtgttcggttgttcatacggagcggggcagacggcagaagcgaaaacaaaggtaaaaacgtatcaaaactgtaaggcgctgaataaggtgtataagggcggcgtggccaaatcgtcgaaagtgaaaaacaagggcggcagaacaaagtacaagccgtatgtatcaaaagcgctttataatgcaaataaaagacttgaccgggataaagactatatcgcatgtgagaaataaaaaaacaagcctctctaaagaggcttgtttttttaaatggattcggcggtgacggcggttccgtatccgattaattcggatgtgttctgtcctgcggtcagttcgaaccgcaggccgacgatggcgttcgctccgagctgctccgcctctctgatcagccgctctttcaccgcttttttggagtcttccagcatttcggtatagcttttcaattcgccgccgacgacagattttaagcctgcaagcaaatcttttccgatgtgacgggactggacgatactgcttgtcaccaagccttttacttccgtaatctgttttccggcgacggtttcggtcgttgtcatgatcatgcggctttcccccttcatgtgtcttaccgctattttatcattaagccgccttttcggctgcgctgatttgtttttttctgactgcggcgctgacggcaaacatgacggcaatgttcagaaccagcgcgatgatgcctgtattcatatccttaatgatctgcggaagaaacggaaagagggttccgacggttgattcggtcagcgtaatgaaggccactgttccgaccccggccgttatgccggcaaaagcgccgtggcttgtgatgaaacgccgcttcggcaggctgaataagagggcggggaaaagctgggtgacaaggctgtagcccattaaaagcaaggtgacgatggtatttccgcctttcagcgtaaaatatacggaaatcagcgcgataacgggtacggcgtattttgcgagccgtgagactttttcgtcagtcgtgccgggcagaatggctttgtacacatttttggcgaacagcgtgcttgaggccattaatatcattgaaccgggtacaagcgccgtcaggatgcccgccgatccgatcagcccgacaaaccagggatcaaaggttttcacagacagctttaataaggcgagatccgtgtccgccccttttaaaccgggcacctgcagaatcgccgcaaatccggtaaagatgacaaacagcaggacgagctgataaagaggcatgatgatcgcgtttttccgaaacacccgcggatgctccgccgaataggaagcggcaaaggtatgaggccacatataaaagccgagggcggtcagcaaaaccgttgagctgaaccaggaaacgctctgtccggtttccggcagcgtgagaaaaccgggttttgcggcgtcaatttgtttgaacatctccgtaaacccgccgtaataatgaatgggcagataaatacctaaatacaggacgatgcctaaaatcatgatatctttgacgacggatatccacgctgaaccgtggattcctgaaatcatcacataaatcgtgatggagacagcgccgatccagacagcggcggagggcggaatctgtccgtatgacgttgctgaaacaattaatccgagccctttcagctgcaggacgagataggggatgagggatgcgatgccgacgagcgatacgagaatgccgaggagcgggctgttgtattttgaaatgaaaaaatctgattgcgacatcagtttgtgttgtttggcgtaagtccacacggctggcagaagccaatatgacaaaatgtaggcaaggcagccgtacgcgataatataaaaggcggggcctccttttccgtaagcccatccgcttccgccgaggaatgtaaaggtcgtgtatatttctcccgccattaataaaaagacaaacatcgtgccgaagccgcgtccgcccaccgtccattgttcaaggtccatatgttttccttttcgggcccggattccgagatatacacaaaacaggagcacggcggccattacgggaaatgctgcattcattccgtctcacccgccttgttttctttgtccaatttgtaaacggcggccatcagaacggaagtcagcaccgcccagatgacgacatatgcgagaatgaaaggcattccgaaaacataaggcgtcacccggttggcaaatggaatgccggcgagaattccgaaaaagggcagggcggcgagaacatgaatcagtttcataacattcctccttttcattgaaaacagcgtgtcccgattataaagaaaatcatgtcgaatgtatagtgtgaatagtctgaattttattttttgaaaaggaaaagcaggcccggctgctttttaaatggtcgcaagagacaggtaatattccaataaggcggtgacctgttcccgtattctcgggttgaaataacggtgtttttcttcatagccgttaatggtgcatatataaagcgtaaatgcttcgtctctttccgcttcgtatattttaattttacgctttcttaactcttttcgaacatcactcaaatccttttgtgctaattttaaagagcagctgataagctgtttatagggttgttttaatttgaacgggcacgaatcaagcgcttcgaggtcccggttcaggatggcggccgccatgggcagaaacagccctttttcgatgagatcgcgggtgccgctccgaatgtcaggcataaatactccttctttcttaaaaaagagaacgtttgttcttattttatactcgcttacacgatatttcaagacggaaaatctcgtaaacattttcgttttttggagataatgtgtagaataaggatagacaaactcgttaaggagtataaacgttggagcattttttatcatatttgactgaggaacagctgacggaatggttccaaagctatagagctttcggcccggcggctgcggctgtattgccttttattgaagcgtttcttccgtttttgccgctcgttgtatttgtggtggcgaatacgaatgcatttggtttgtgggaaggtttttttctgtcatggctcgggtctgcgtcaggatcgatgctgatgttttatgccgtccgccgtttcggacagaaaagagctttcggtttcatccgcaggcatcagaccataaggcggatgatgctctgggttgagcggcacggtttcggtccgctgtttattttactttgcttcccctttacgccgtccgctgcggttcatatcgttgccggtctgtcacgggtgggggcgctgcagtttatatcagcagccgcgatggggaaaatggttatgatctttatgatcagttttatcgggtatgatcttcacgcactcattacacagcctttcaggatggcgggcgccataatggtgatcgcggtgctgtggtatgccggaaagcatatcgaacggcgtttacagacgagaatcagtcagcatgagaaagacggagggagacaggaatcttgaaaaaacgattttggtttatagccggcgtgcttatcgttgttttggccatacaattaaagaatgccatttttattgattataaagtcgaaggaatcagcatgaatccgacctttaaacaaggaaatgagctgatggtcaacaagttttcccatcgttacaaaacgatccgccgtttcgatattgttctgtttaaaggcccgcaccgcaaagtgctgatcaaacgtgtcatcgggctccccggcgagtcaatcgcatacagggaggatcagctgtatgtgaatggaaaacgggtggcggaaccgtttttaaaaccgttaaagtcatcattgtccgccgggagccatgtgactggtgattatacgctgaaggaaacgaccgggcgcaaaagcataccgaagggacaatactttgttattggcgacaaccgcatatacagcctcgacagccgtcatttcggtccgattaaggataaagacattgtcggagtcatcagtgaatcagacgccaagtgaacggcgtctttttttcggaaatgattgtcaaaaagcggaggaaagactataatgaaaattgttacgcgcgaaacaaaaaaggaggtgttttatttttcatatttttgttacgcgcgcaacaaaaatatgaaagagggctgatgaaatgaaaacacaggctgccattatcgggggaggtccggtcgggcttatgcttgcatcagaactggcgctggccggagtgaaaacgactgtcattgaacgattgaagaagacgatgccgtattccaaagcgcttatcatgcatccgcgcacacttgagctttttgccatgagaggcatattggaacgcttcttggaaaaagggacgaaggtgtcttccggccatttttccatgctggatacacggctggatttttctcggctggatacgaagcagaattattcgttaatgctgccacaggcagaaacggagcggatgttggaggagtatgcatcaagtctcggcgcagacatcatccgcggggcggaagcggtggctgtcacccagacggatgacggagtggagacggtgttccgggacgaaagcggaatccgcactcttcacagcttatatgccgcgggtacagacggagcggggagcattgtccggaaacaggcgggcatcgctttttcgggcactgatgccgacttaacaggaaccctttgtgatgccgctttgaaacatccgcccgaatcttcctttttttcaacgtgccggctggagggatcggttgtgattatccctcttacggacggacttttccgtgtcctcatcgtttctccgcatgtcccgcaaaagcggaaggaagagcgggtcaccgaagatgagctgaaagaagacctgcggcggatatgcggcactgatttcggattgagtgatccggtatggatgtcgcggttcggcaatgccgagcgtcaggctgagcagtaccgctccggccggatttttgtggccggggatgcggcgcacattcattttcccgcaggcggccaaggcctgaatacggggcttcaggatgccgtcaatctcggctggaagctggcggcgcaaatgaagggaaaagcggcgcctcatcttctggacagctatcatcaggaaaggcacagcacaggaaaagaagtgctgcacaatatcaaaacgcagataaagctcatggattttaccgagtcggggatggcattaagagaaacgatgaccgctttgctggattttcaggagtccaaccgtttattggcgggaaaagtatccgcgcttgatctgcattatgaaccggatgcggagctgccgccgcataccctgaacggaaaacgcctgccggatatcgaactgacccttcatgacgggcggccggcccggctgtatgattttctccgcaagggcggctttgtgcttctgtcattaagagggagcattcccgccggtattgatacggacagcgtggcggcagtcagggcggagcttgctgaaacacgtgccgattggaatgacgtccacaccgttttaatccggccggacggccatgcggcatgggcagccggcggctcgggacgtgaagcggaagaagccgttctggccggtttggagagatggggattattcatctgataacctttttatgcgcctgtgtgattgtttcttatgtaacaaaacgttatagtaaaagaaacaatcaatacggaagggtgactcagcagttggacagaagacagccagaccatgcaaaacacatgattcttgaagggctgaccgatatttttcacgagcaggagaggtgtcaggaggatatcagggcgtcgttggccggacggatggatgaactccgcgaaggaaacgggaaaaaattacaattgaccttgacggaaattcacattttgtcgtgtatcggagatcatgaaccgatcaatgtcacgtcaatagcggaaaaaatgaagacgacaaagccgaccgtgtcgagaagctgcgcgaagtttttggaagccggctttctgcgcagaacccggctgagtgacaataaaaaagaagtctatttccggctgactcctgccgggaaagagctgcattcccttcatcatgaatatcatgaattgataaaacagcggctcttggcgtttttagaccgctatacagatgaagaactgttatttgctgaacggctgttccgtgatctgtcagcaaactggcggtctgtaaatggcggcggagagctgttcaaataaaaaacacgcatatggatgcgtgttttttattcggatcatgttcctctttctgcccggcctctttcgccgtgtgcccgtttcagctgagaaaggtggtgcagcagccgatagaagggcggaagcatggcgatgacgagaacgatccggatgacctgaaccgcgacgacgaaagtcgagtcttcgtgcagggtgatcgaagtcgccgccatctcggcgatcccgccgggagaaaaggcgagaacagatgtaatcatggagatgcccgttaatttagaaaccgcaaccgcgctcagaatcatggcggcgattaatccgacggaagaaataaatccgacggtcagcactctcgtcacaccggtgaacatgcttttgtacatttttgatccgattgtggcgccgagaaaaatttgtgacagctggttcgcttccggcggccaccaggccagcatgtctttgcccgccaaggcggacacgccgatttccgcagcagcaacgccgatcatgctgccgagcagccaaggggcggggaatttcagccgttttgcgcctttacttgcaagccaggcagctaaaataaatccggccgttaacaagacgggaataaggcccggatgtgaagctcctgctgaaacggctccggctgatgtctgagccgcaccgttttgtttggtaaataagaaaatgacgagaaacggtattgtcatgacgaccaaaaggacgcgcgtcagctgaataaggcttacaatcgcggtgtttgcgccgacttcctgggcgatacccggcatggcggataaaccgcccggcgccgttcctacaaagcttgtcatcatgtccgtccggctgaaccgaaagagcacatatccggaaacaagcgccatcacgatagagaaaatcagcatgaagcctaccggaagccaatgctcccgtaaaaccgacagaacggacaggttcaatttctggccgagttcgatgccgaggatcatttgtcccgccgcaagccatctgcggtgaatccctcttctgtcaggcgccatgaacagccagccgggcctcgtcatggagaggatgcagccggcggcaagcgttccgagcatccaggcgatcgacatccctgtaagcgaaagaagaaacccccctgccgcactgatgagaataaaccagatatccgtaaggagatgtttgtctttcttcaatgaaaacccttcttcctgaaacattcatattaaattgttaagctcgttaaccttactattactatagtatagattttgagataaataaataatgaattatttctcataatccattcatttttcttatcgaaaacataaaaaaagctccggagatgggtgagtgcaccctactccgaaacctcgcccgcttttcctttccacacaagcgtcaatcccagaccgagaaataaaaccacacctgcgaacagaaacgggaagtgaatattcatatcaaataaaataccgcccagagccgggccgaaaatggtgcccaaactcgtgtatgttgagttcataccggcaacaaacccctgctgatttcctgcgatcttcgatagataagtagtcagtgccgggcgcagtaaatcaaacgcaaggaaaatgatgcaggtgacagcgagcacgggcaaaaaccctgacatcaccgtagaaacgaaagccagcacagcgccgatgatcagacaaagctgaatgacttttttctccccgaggaagttgacaagtctgccgaacgcgagcacttgaatgaggactgccacaatggagctgaacgtaataataatggcgatatcctttggcgtgaagccgaatttatggtttgtaaataagctgaataccgtttcgtacgccgacagcccgaatgccaaaacaaaaacgatgataaaggcgatcaagtagcttggatgaatcgactttttcaaatcttttaagaaggttgattctttggcgctttccatctgctttgcgcgttcttctttagttaacggctctttcagcataaagacagaggaaatcactgcgataaatgcaattcccgccgcaaagaaaaacggcatacgaacgccgtgatcggcaataaatcctcctatgccgggcccgatgataaaccctgtgctgatggcggcagatacatagcccatcgccttcgatctttcctgcaccgtcgtaatatctgcgacatacgctgtaacggcgggcatgataaaagcggcactgatgccccccagcacccttgcgaaatataaaatggagacatgtgtgcccaatccgaaggtcagctcggataatgcgaacaaaaacagtccggcgagaatcatgatttttctgccgaaacggtcaacccatctccccgcaatgggagatgcaattaattgcgcgacggcgaaggcagcgacaaggtatcccattgtgctgcccgtcaagtgcatcacattcataaacagcggcataacgggaatgatcaatccgatgcctaaaaacgcaataaatatgttgcttaataagatgatgagtacagccttttgttctctgatcggtttttgcatgttgtttctcctttgtcagctgtcattcagtttatcagcgttgatcgacccgtgaataaacacggagatggcttctttttgcaattcgattctttgctgaatggtatcgtttttatataacacatctaaaccgtagaagacggatagcaggatttttacttttgattcgacatgatgaatggaccagcttccgtcttgatttccttcttctaagatctctctcatcacatcgtcatattcaatatcaattttgttgagccgctttacgacctcctctgacgtaaacgcactcgcataaaactcttcacttgctctcataagcgggtaattgatgctcatccggctgagcagctccgcaaagcccgtcagcttttcggcagcatctttcagatcagcttccatttccctccacgtctcgatcatcacgcggtgatcctcttccatgatatgaagaaacagaaactcttttcctttaaaatggtgataaagattgcctttactgatctcggccgcctctaaaatatcccgaatcgatgtttctgaatatcctttttttgcaaataagtcacgcgaagcggatacgagcctgttcttcgtcttttcgctctttccggcaccgccttttgtatttgtcacttcacacagatcctttccgcctcattcatatcgttgtcccggcaaagcggggctcggttcgtttaaaaccgaccagttggtttattttattataaagggtttttgctgactatacaatgaagaagttatccattgtttagtggaagtataaaaacggctcgaaaaataaaccccattctctcctgttgaaagaacggggtttgccgtctatgactcccagcggggagcgtctgaatcgttattttccggtatttacctcggtgtagcttgtgttcggcgagtttgataccgttccccctgtatggtggaaaggagagtgggccatatcgtataaaaaccagacggcatgacgctgctcgtcaaatgccgtgcgggcaaataaccgtttcgcttccggatgcaccgctctatcggatgcctgtaaataaaaatcattcgttttctgctcatcataaaacgccgccctcagtccttctctgtatgtgtgcggacaatgctccgtctgtttcggcgtcaactgttttccggtaattgacgtatacagtgaagagaaagcgtgcatgtggcgcacttcttcctctctgatatgttcgattcgtcttctgatttctgcggtcggcgctttttcggctaatattgagtagcaaatcacagcgctgtattcaccgtttatggattttaccagatcctttataagcacagaatcgtcactgcagatggctgtataatgaaaaaaattctcgtgcattggactcacccccggatgtttatagggtattatacggcggcagcccgtgacatgtgcggatgtcatttttattcttgatccagcggcgatgtaatatggtcgtcgtatgtgtcgacaaaaagccggccgttgcttccgcgcacagcgtatacgacgtcttccggtttgaggtttctcttatccaattcttctctcagccatttttccgatacgtggttttcttccagatttttcattaccagccggccgtccataatcagctcaacggcaaagttcttttcatgtccggcaaagatgccgagatcctgtcttgtaacgggcgcaaattccggtttgacctccactgacatgctgccgtttgtttcaatgatggcagtctgaacctgagaaatgtcaaatacatcattttcacgaagctgctggttcaagtagtcgagggtatagcgcatctttttcatattatgctcaagtatttttccgttttgaatgataatggtcggtttgcctgcaaagaaacccctggcagttctgtttttcatagaaagatatgcgacaagataaatgataaccacaaaaatcgtgtaagcactgacagtaaaatgaatcggcagttttgtattaaacgacagattggctgtgatggcgccgagcgagatggccgcaatgaaatcaaaaagcgtcatctgtgaaatggtttgttttccgagtatacgggcgccgataaacagaatgctgaacgacagaatcgttcgcacaatcacttcgggatattctgacatcatatttaatcctttttttctttaatttggtcaaaaacgatatgttttaaaacagtcatcccgtttttaccagcagatgagattggtcattttcgtcaactttcgataaaatgtagaaagataaaaagagagggtcttctaatttgggtgttgagtttttagtaggcagatcggggagtgggaaaacgaggctgattatcgacagcattcaagatgaactgcgccgggagccgttcgggaaaccgatcatttttctagtcccggatcaaatgacgtttttaatggaatatgagcttgctaaaacgccggatatcggaggcatgatacgcgctcaagtgttcagtttttcgcgtttggcgtggcgcgtgcttcagcataccgggggcatgaaccgtccgtttgtgacgacgacgggtgtgcagatgcttttaaggaaactgattgaagaacataagcacgattttaaagtgtatcaaaaagcgagtgacaaagccggattcactgagcaggtggaacggatgctgacagagtttaagcgatactgtattgagcctgaagacgtccgccgcatggcggaaagcggaacggcgtcagagtatcgcggagagcggatgctgtctgaaaaacttcatgacttaggcattttatatcagcagatggaaagaagcctcgccggacactatctgcattcggaggactatttgacgctgctcgctcagcagattcctttggcggacgttgtaaaaggcgcccgtgtttacgtcgacggattctatcaatttacgccgcaggaattaagggtgctggagcagctgatcatgcatgctgaacatgtcacattctcgctgacggcggacagcccttcggcggaacaggcaccggatgagctcgatctgttcagaatgacgggaagcacatactataagctttatcagacggcaaaggaattgaatgccgatatttcctgcaaggaactgcatggcacgaagcggcatcggcatgtgccggagcttgcctgtatagagtcgcagtacgatgtgcgtcccgccgccgcgtataccggcggacaggaagcttttaccgtcatgcaggcgcaaaacagaagagctgagctcgaaggtattgcccgggaaattcaatcgcttgtccgggacggaggataccggtacaaagatatggcgattctcatccgtcagccggaagattataaagatttgctgaaggaagtgtttgccgattacgggcttccttattttattgacggaaaagcttctatgcagcatcacccgcttattgaattcatccgttcaagcctggatgtcgtgaaggggaactggagatatgaagcggtgttccgctgtgcgaaaaccgaactgttattcccgcttgatcagccggagcagaaaataagagagcaggtagatcagcttgaaaattactgtatcgcctacggcattaaaggggagcgctggacgaacggcgagcggtttgtatacaggcgcttcgtatcgctcgatgaggatttcgcgcagacggatcaggaaatcgagatggaacacatgctgaatgagacgagagagtggatagctgcaccccttatccggctgcagaaccggatgaaaaaagcgaaaacggttcaaagcatggcggaggctctttatctctttttggaagataccgatgttcccctgaagctggaccggaaaaggcagcgggccgaagaggccggaaacatgatcgaagcgcagcagcacggccaggcgtgggatgccgttatccagcttctcgaggagtttgccggcatgatgggtgaagatgaaatatctttggcgctgttccagcaaatgcttgaaacgggaacggaatcgcttcatttttctttaattcctcctgcgcttgaccaagtatttgtagggaatatggatctctcaagaatatacggcacgtcctgcacattcgtcatcggggccaatgacggcgttcttccggcgcgcccggatgaaaacggcgtgctgtctgatgatgaccgggagtggctgaaagcggtcggagtggagctgtcttccgcggggcgtgagcggctgcttgatgagcattttctcatctatatggcgctgtcgagtccgtctgaccgtctttatgtgtcatacccgattgccgatgcggaaggaaaaacgctcctgccgtcaatcgttgtaaacaggcttggcgagctgtttcccgatcatcaggaaaagctgtcagcggctgatcccgagcaggtaagcgaagaagagcagcttcagtatctcgtcaataaacaggtggctcagacgtatacggcaagtcagctcaggctgtggacaagagagtacgagatcagtgacgtatggtggagcgcatacaatgtgctgatgaaagagtctgatcaccagcgtgcgaaaaagctgttttcaagcctatttttccgcaatgaggcgaagcgtcttgaacggcctgtttcgcgccagctttacggcgagcatattaaaggaagcgtttcccggatggaggcgtttaatgcctgccagttttctcattttgcatctcacgggctgcaattaaaagagcggcagtttttcaagctggaagcgccggatatcggccagctgtttcactccagtctgaagctgatttcagaccggcttcgtgagcagaagctggaatggcgcgatctgacgaaagatcagtgccggaatttctcctatgaagcggtggaacggcttgcgccaaagctgcaaaaagagattctgctcagctcaaacagacacttttacgtgaaggaaaaactgcagaagatcgtcacgcgtgtttctggcatattaagcgagcatgcgaaggcgagcggtttcgtcccggtcggtcttgaactcggtttcggcggaagcggaccgctgcctccgctcactttcacgctgaaaaacggctgtacgatggaactcgtcggacggatcgaccgcgtggataaagcggaaagttcaaaaggcctgctgctgagaatcgttgattataaatcaagcgacagggggcttgatctggctgaggtgtattacgggctcgctctgcaaatgctcacatatcttgacttatcgattacacattctgcggattggctcggcatgaaagcgaccccggcaggcgttttgtatttccatatccatgatccgatgattcaggccagtctgccgatggggcttgatgaaatcgagcaggaaattttcaagaaatttaaaatgaaaggccttctcctcggtgaccgggaggcgatcagcctgatggacacgactttggaggaagggcgttcaaatatcgtcaatgccggtttgaaaaaggacgggtctttaagatccgactcagcggcggtcagcgaacaggactttcatctgctgacagaccacgtgcggcggacatttgaacaggcgggcgaagcgataacggacgggcttgtgtccattaccccgtataagctgaaagataagacgccttgtacgtactgtgcgtttaaatcggtttgccagtttgatgagtcgcttaaggaaaatgaataccgcagcctgaaagcggaaaaagacggcaccatactggattggctgaaaaaggaggcggatgatgatgcaaattcctaaaccgaaagacagcatatggacggatgaccaatggagcgccatcgtttcttccggccgcgatattcttgtcgctgccgcagccggatcaggtaaaacggccgtgctcgtggaacggatgatcagaaagataaccgcggaggaagatcctgttgatgttgacaggctccttgtggtgacctttacaaacgcctcagcagcggagatgaagcatcggatcgctgaagcattagaaaaagagctcgccaaaaatccgggatctctgcatatcagacggcagctctctctattaaatcgggcgagcatttcgacgcttcactctttctgtctgcaagtgcttaaaaaatattattatatgattgatcttgaccccggttttcgcatggctgaccagacggaaggcgaattgctcggagacgaagtgcttgatgagctgtttgaagatgaatacgcaaaagggaatcaggcgttttttgagcttgcagacagatatacgacagacaggcatgatctggatcttcaagaccttgtcaaacgggtgtacgagtattcccggtcgcatcctgacccggaagcgtggctgcagagctttgtccgcttgtatgacgtgacggaagaaagcaaaatggaagagcttccgttttaccagtatgtgagagaagatgcggaaatggcgctcttcggggcaaaacaaaagcttgagaaggcgcttgaactgacaaaagcgcccggcgggccggccccgcgcgctggtaattttctggatgaccttcagcagatagaagagctgatcagctgccggcatgacttcgatgcgctgtatgaacgggtccccgcagtctcatttaagcgggcgaagccggtaaagggtgatgaatttgacaaagcgcttttggacgaagcgaccgatttgcgaaacggcgcgaagaaactgatcgaaaagttaaagaccgattactttacaagaagtccgcaagatcacttgaagagtttaacagatatgaagcctgtcatcgaaacgctcgttcagctcgtgatatcgtacggaaaacgatttgaagcggcgaaacaagaaaaatcaattattgatttctcagatttggaacattactgcctggcgattctaactgcggttgatgaagaaggccggcgggtgccgagcgaagcggccgtttattatcaagaccagtttcatgaagttctggttgatgaatatcaagataccaatcttgtgcaggagtctatcctgcagcttgtgaaaagcggggatgaagaggcgggaaatctgtttatggtaggcgacgttaaacaatcgatctaccgtttcagacttgctgagccgctgctgtttctcgggaaatataaaaggtttacagaaagcggggaaggcgcggggcagaaaattgacctgaaccaaaatttccgcagccgttccgatattttggacagtacgaatttcttgtttaagcagctgatgggcggaaaaatcggcgaagtggactacgatgaacaggcggcattgaagctcggcgcatcgtatccgccgaatgacgcggcaaaaacggaactgctgctgattgacagcgctgatgacgcagacagctccgaggatgccgaagactttgaaaccgtgcattgggaagcgaaagcgatagccggggagatccgaaagcttgtctcgtctccgtttaaggtctatgacgggaaaacaaaaacacaccggaatatccagtaccgggatatcgtgattttgctgcgctccatgccgtgggcgccgcaattaatggaagagctgaaaaaccagggcattccggtgtacgccaatttgacgtcgggttactttgaagccgtggaggtggctgcggcgctttcagtcttgaaggtgattgataatccgtatcaggatattccgcttgcttccgtgctgcgctcgcccatcgtcggctgtgacgaaaatgaacttgcgctgatacgccttgaaaagaaaaaagcgccgttttatgaagcgctgaaagcatatatagcgaacggtgacaggcatgatgaactgtatcaaaaactgagaaccttttatgacagtctgcaaaagtggcggtcattttcgacgaatcattcggtgtctgagctgatttgggaagtataccgcgataccggatattttgactatgcaggcggcatgcccggcggaaagcagcgccaggccaatctgcgcgtcttgtatgaccgggcgcgctcgtacgaagcgacggcgttccgcgggttattccgctttttgcggtttattgaacggatgcaggagcgcggcgatgatctggggaccgcccgtgcgctcagcgagcaggaggatgtcgttcggctgatgacgatccacagcagcaaaggacttgaatttcccgtcgttttcaccgctggactcggcagaagttttaatatgatggatctcaacaaatcatacctgcttgataaagagctcggtttcggcacgaagtatattcatccggaactcagaatcagctatccgactcttccgcttgtggcgatgaagaaaaagatgcgcagagagctcttatccgaagaattgcgcgtattgtatgtggcgctgaccagagcgaaggaaaagctgtttctcgtcggttcctgcaaaaaccgggaaaaacagctggccaaatggcaggcccaagcagaccgggctgattggcttctttctgaattcgaccgctatcaggcgtcatcttatttggactttatcgggccggcgctcatccgccaccgtgacatggaggcgcacaggacgccgggactttcttcgtctgaggatatcgcgcgcgacccgtcgcgttttcacatccggatgctgcagcaaagtgaattgctggaagagaatccaaaagaacgtgctgaagaaaagagcaaacgtctcaaggcgatacagcagggcgagccgattcctggttcgttttcatttgatgatcaggcgcgccgtctgcttaaatgggaatatccgtaccgagagctgacggctatcagaacgaagcagtcagtttctgagctgaagagaaagcaagagtacgaggatgaatacagcggccgctctctcatcaaaccgtcaggagacacgcttttatacaggcgtcccggttttatgatgaaaaaagggctgacagccgccgaaaaagggacggcgatgcatacggtgatgcagcacataccgctgacgcacattccgactgccgaagaagcagagcggacggtccggatgctttacgaaaaagagctgctgacagaagagcagcaggaagccattgatatagaagaaattgtccggtttttcggaactgaaatcggtaaagaccttctcggggcgctgcggattgaccgggaagtgccgttcagtatggcgcttccggccggcgaggtgtacaaggatgccgaaacggccggtgaaccgctgctcgtgcaagggattattgactgcctctacgaaactgcggacggtctctatttgctggactataaaacagatcggatagaggggaaattccggaatggatttgaaggcgcggctccgattctgcaaaaaagatatgaaacacaaatcgaattgtatacaaaagcggttgaacaaattacaaaaacgaaagtgaaagggcgtgcgctctatttcttcgatggaggtcacgttcttacactgtaacgagatccgaagctcctttttggagcggatctttttttctatcaaaaagtgaggtgaatgcggtatgcgcattttacatacagctgactggcacctcggcaaaacgctggaaggcagaagccggctgagcgagcaggccgaagtactggaagagctgaataccattgtcaaggaagaaaacattgatgcggtcattatggcgggggatgtattcgatacggtcaacccgcctgcgctcgctgaacaattgtattacgaaagtctttccgcgctttctgacggcggaaaacgcccggttgtcgtcattgccggaaaccatgacaatcccgacaggctggcggcggcttctccgttaacaaatgagcgcggcattcatttaatcggctatccgcggacagaacccgtccatattgaggtgccgtcggcggacgagctgttagccgtagccgcgctggcatatccgtcagaggcgagattaaacgaagtgctttctgatacgtttgaggaaaagcttcttcgcgatcattacgatgtgaaaatcagagaggcgtttgctcacatgtgcggactgtgccggaacgatgccgtgaaaatcgcggcgagccacatttatgtcgcggggggaaatcagaccgattcagagcgtccgattgaagtcgggggcgcctacacggtcgccgctgacagcctgccggctgatgcggcttacgtggctctcggccatctccaccgtccgcaaacgatcaagcgcgccaagacggctgcccgttattcaggctctccgctcgcatacagcttttcggaagccggttatgccaaatcggtgacagtggtagaagcgaagcccggcggagaagcgaagtgggaagagattttcctgtcttccggtaaaccgctcgtcaaatggaaagcgcaggggctgagcgaggttcacggctggcttgatgaagggcgtgaccggaatgcctggatcgatcttgatatccatttgacggatcagctttctctcgaggaaattcatcggctgagaaaggcgcatcccggctttatccatatcaggccggtttttgaagaaaaagagaccgaaaatgaccggattgaagtgaaacacacatcaattgaggatcgatttaagaagttttatgaaaaacaaacgggcggcggcgtgccggatgaggagatggtcaagctgtttttagagcttgcgtcagcagatgatgaggaggatgcgacatgaagccgattctgttaacgataaaagggctccacagcttcagggaggaacagaccattgattttgccggactgtcaggagccggggtgttcgggattttcgggccgaccggaagcggaaaatcgtcgatccttgatgccatgacactcgctttatacggaaaagtggagcgcgccgcaaataatacgcacggcattctgaatcatgccgaagatcagcttgccgtctcatttacattcgcgcttcaatccggccaccgggtttcctacaaggtcgagcgcgtttttaagagaacggatgaaacgaaagtaaaaaccgccctctgccggctgattgaaatcaaagacgaacaaacggtgctggccgataaagcgaatgaagtgaacaaaaaggtagaggagcttcttggcctgaccattgacgactttacaagagccgtcgtgctgccgcaaggaaagtttgccgagtttctgtcgcttaaaggcgcggaaagaagacatatgctccagcgtctgtttaatctggaacagtacggggacaggcttgtcaaaaaattgcggcggcgggcgcaggaagcggcagcgaaaaaaaatgaaatgctggccgaacaatccggcctcggagacgcaggagaagatgcgctgaagcaggctgaacagcagtttcacgaagcgaacgaacggcttgaagcagctgagaagaaacgggtccgggcaaaagagcgttttgaaaatcaccaggaaatttggaacttgcagacagaaagagatgaatatgagcgccgggagaaaaagcttgaggaaagacgcccgtacatcacggatttgactgagcgtcttaaagaggcggaaacagctctcgcccttgagccgtacgcagaccgctgcaccgaagccgtccgccggaagcagcgagccgaacaggaacacgaactggccaaacggaaatcagaggcggaaaccgtttcatttacccggcaaaatgaagcctatgaagcatggcgcgcccataaggccgaacaggagccgaaacttgtcaaggaagaagagctgtatcaaagactttcagccattgaacaaaaactgcttgaagcgaaaaaagaagcggaaaaaacaaatgcggagcacagcaaaaaagaggaagaatacgaagccgcctcgaaacagctggccgcagtgaaagaccgcctgacccgcggccaaaacaggcagaatgagctgaaagaagagctgaaagcagttcaagtgaccgcagatgaacggaaaaaatgccagaccgcagcacagctggcggcaggctttcagcagacacaggaacaaatcacgaaagagcgggccaatctgacaacgcagctgaaaaacgtggagaagctcaacggagaaagcgagtcgctcacagcgaaagcgaaaacggaagaggaagacattacgcgcgcttatcaaacgctgcaaaccgtttaccatatggtctgtgaaacggaacgttcactgaaagccgcagccgaacgggctgaaaaaacgcaagccgatctccgcaggcgctcagaggaagcgagaacggctgcattaacaaaagaattatcggaaaaactgatcgaaggaaagccttgtcctgtatgcggctcgacgcagcatgaccgcccgcgttccgctcatgaaacattctcgcctgataccgctgtgcaggaacatttgcagcaggtggaagcactgctttctgaggcggcggctctttctcaggaagtgctgacagccaaggttgcattagaagaacagtcggggcgttttaccgaagaatgtccgtttctgcaaagcgcccgggttccggagctggaagccgcttcttccatcagcggacgcccgcttgatgaagcgttcagcgccgtccgcttggaatggaaacaaatgaaacaggatatgctgtcggtaaaagagaaggtcgcaagactgatcagcgcgcatcagcagacggtaaaacaagctgagcagcttgccgaacgaatccgctacgaggaaaaagaagccgaccgtctcagacattcattagaagagcttgaatcgctgtcagaaagccgattgaatcagtacaacgaagtctgcggtcatattccgccaaaccggattgacgcctggcaggcttcgatagatgagaaggacaggcaggcagaagaatgtgagaagcgcattgaaacaagcatcgcattcctcaaggaacatgaagaggagaaagaacgcctgcaggagatgaagcatcggcttgaacgggaacggctcgagcttcactatgcgtctgagcgcctgcagcaggtgattgacggatatgaacaagagctcggaacagcagctgaagaaacatcaatttccgcaaagcttgaagcggtgcggcaggaattacagctgttaaaatcaaaagaacagtccctattcgatgcgctgaagcaggcgcagcaatcgctgaatgacgcaaaaggccgggaatcagggagtctcatgtcactcagggatgctgaggcctctcttgagaaagcgcaaaacgactggcgcgtgaggtcaaaagacaccgggtttaccgaaccggaccaagttaaaaaaagtctgcttccgcaagggcgtgcagaggaaatgaaaaaagaaattgatgagtttctggacacctcaaaacagctatcggcaaatatcagccgtgttactgataaattagccgagcgccggatatcggaggaagaatggacagcatccgtttctctgctgaagcaggcagaggctgagtcaggcgccgccatggaggaaaaaggagcacaggcaaaagccttcgcggttatgcaaaaacagcataagcgctttaaagagattgaagccgaactgaaaaactggcagacacagattgacaggcttgataagctccagtctgtatgtaaaggcaatacattcgtcgaatttttagcggaagaacagctggaaagcgtggctcgggacgcctctgcccgtctcggagcgctgacaaggcagcggtatgccatattagtcgattcagaaggcggtttcgtcatgcgtgatgacgcgaacggaggcgtcaaacggcccgtatcaagcctttccggcggggagacgtttctgacatcgctgtcgcttgcgctggccttgtccgcccagattcagctgcgggggcaatacccgctgcaattctttttcttagatgaaggattcgggactcttgaccaagggctcttagacaccgttgtcacagcgctcgaaaagctgcaatcggacaacttatccgtcggagtgatcagccatgtgcaggagctgagagcgcgtctgccgaaaaaattaatcgttcatccgtccgaaccgggcgggaaaggcacccgggtcacattggagatcatgtagaaaggagaaggaattatggccgattctgccgagggtacatgtgaattatgcggccgccattatgtgcggctgacggagcaccacttaacgcctaaggaagaaggcgggacattccttccgaccgcaatgctctgcatcccttgtcataaacaggttcacgcgctctatacgaatcaggagcttgcggcaaggctcgcgggaatagaagagctgcggcgtgacccgaaactcgcgcggtttgtgaaatggatcagaaaacagccgccggaaaagcttgtaaaaacaaaaaaagcaaatgaacgaaaataacgctgaaccaaaagcagccctcttctgaaagagcggctgctttttaggcgtttccgaccacattttgatcgctgacatcggggtctatatagtttgtcgcattgacaacgttgtttaataacaggaaatctccggtattgcctgctcccgaaccgagcgcagatttagaagagctttttggagaaaggtaaaaggaatcaccaaagtttacgactccgcccgatatggaattgatagctataggtccggtaattgctggcataaacgacaccctttatagaagtctcaccgtcattatatgtcagggctgctgtgattgtgagcttggcgtgaagatctgcctaatatgtttcagccgcgaatctcccagaacgaccgacgtcgatccgatttgaaccacggacgctgacgataccccttgaactttcacattccttacccgaattgaaggattttcatggcagaatgcgctttggactcccgtttccggtaacggcatgacggccggctgccgaaagatctggtattcttttttgttaaatgagccttcatcatctctgtatacagcaagactgcgctgatcggccaatactttgatccgcatattgatttcattcgtatcgcctgcttgaaagacactcgcaatcccgactgaattgattttggcgttccggaggcgtgaaatgcgctttaacattattccggcgccagcggcacataaggcccgataataagagattccggaggcgtgtcaaagatggaagacagatagacggaatcggtgtcgccgattaataataaggaagaactggatacaccagtagaccggatgtcgccgacttcaatattccggttaatcactgtaaaaatcatgacggatcatcacctttcatttcaccaggtatgtgtttaataaagtgctcgacggccctgacaatatcacgcttcacatgttcggcaatctgctcggcatattgcgcgggcgccgtattttcttctttcgggacatgggacagataatactgaatccggctgtccatctgctttctgatatcttcaataatatgatatttgttcgtttcgtccagcctgctctcatactgagtttcgagctgctctaaaagcgcggggatttcttcattcaggtacatatcgacgttttgacggatttgctgcatttgctggcccgcctgttcctgctgcatcattccgacctgcggagatgtctggccgacttcgaagttttgcacggcattcggatcagtcggattcaatccgatattcagcgttccttccagccgttcaattttcagctgatcaaatttatactcgagccgatcgattcttgtagaaggctgctgcttcagcgttgaaatttcattttggaattctttcagctgccgttcgagctcctgaatctgctgcgcctgctgctggacgaaagaatttaaattctgcaggtaggatgaaacggattgatcatacatgacattcacctcgcgtctcgtttccttcattaaaactaccggcttggcggctggagcggtacaaatgatgaggtgccgggacctccccctgttgttacagcctgctgccccgcggtgacaggcggcgccggctcaacataactccctgtgttgtacagattggaaagagatttaattgaaccggcgcttccgatttgcagtatggaggaattgctgacagattctacacgcatgtaattgatatggatcgactgattgacgtaaaaattcatacggcgcctcctttatgcgtttcctgccatcggctgatcgattacatcattatcgtacacattcgttgaattcctgtaattcgtcagtgtgagattgtctccggtattgaagctgcccgctccggcaaatgtcttaacctctgcttttggagaaatggtgatgcagtcgcctatatgaacgactccgctcgtaccgacggcattaattttaaacgctccgacaattgcgggcatacgagcacatccttttcgtgaagattttcatgactgcactccaggagcttatctgggctgcctgcctaaaatagcttatgacaaatgcacatttttgtgagcggaaaaaactttagacgtaaaaaacaccggcgctttacagatgccgggtcttatacataaatgatacagatttatatacatatcacgtttatgagaaagcctcttttctttcgcggccgtgctgaatctgtgcggccgggttcggcccgctgtctttcgtttgttggatgagcccgccccggcacccgtttaaaaggctgtccagctcctggctgcacctgatggtctccgtcgcattgattccgaatttttgcgctgtctcgaataaagttaatcttttttcttcaattttgttcatcgtgtgatctccaattctcgattattttggaaaacataggatgataatagtataacccattttggccaagaaggttttatttcgtcaatatgactaaaaaagtgacaatttttgatactcttttacacttattttcagcctgtttaaaagagggatttcccgcccggaggaagaatacataaaggaatgccatttaaaaatgatgggggattaacatgaaatttgcaacaggggaactgaacagccgaaaatttgtcggtctgattattgatgatgacaaaatcttagatctgcaaaaggctgaaaaaaaattgtttgaacttgagacgattccgggttcgctgatcgagtgcattcaaaaaggagataagttcgtcgcgcatgccggacagcttgcggaatgggcgaaaaaaccgaatgacgagtcgggttcatttatgtatgcgctgtctgacgtaaagctttgcgcgcctattccgagaccttcaaagaacgtgatctgcatcgggaaaaattatcgtgatcatgccgttgaaatggggagtgaggcggatataccggagcatcccatggtttttacgaaagccccggctgccgttacaggccacggagaaacagtgaacagccacttggatgtaacggagcagcttgattatgaaggggagcttgcggtaatcatatcaaaaagcggatcgcacatctccaaagaacatgcgcttgatcatatattcggctatacaattgtaaatgatatcacagcgcgcgatctgcagaaaaaacataaacagttttttatcggcaaaagcctcgatacgacatgtccgatgggcccggtcattgtacataagtcggccgtcagtgatccgcaaagcctgaaagttgaaacgcgggtgaacggagaactgcgccaatcaggatcaacgggtgacatgatttttccgatagctgaattaattgagacgctgtcaaaagggatgacgcttgaagccggtgacattatagcgacgggaacgccgtccggtgtcggaaaagggtttaagccgccgaaatttttaaagccgggggaccgcattgacattacaattgaaccgatcggcacgctgtcgaaccaaatcggataattgtgtgtctttcgcacgattgataatgctccgagcggcttgttgtggtaccataaatgaggcagattgatctgatagggggaattgaacataatgacacattggcatattacttcatgggtcgttgcgcttatcctggtgtttgtcagctacgggctgtacggtgccggaaaagcgaagggcgcaaaaattacgcatatgattctgcgcttattctacattattattattctgaccggagctgagctttttgtccgttttgcgaattggaacggagagtacgcaggaaaaatgctgctcggcatcattaccatcggactgatggaaatgctcgtcatccgcaagaaaaaaggcaaatcaaccggcggactgtggatcggttttattatcgtgctcgtcctgacggtgctgctgggccttcacttgccgatcggttttcacgtattttaatcaatcgcttgaaaaacccggatgcatccgggttttttttagttgcgcaactgggccgctgaatgagaaatgccgtgttgatgaggcgaaagagatgtccaggatgccaaaagcgtcaatcactcttgttgccgcaaaagctacggctgtgaagggtaaaagcaaacgccggccgtcaatcagcgtgaaaaacaaagctgaatacatcaggcggcacctatttaaaaggtgccgcctgtttgttacgcggtgccgtcttgtcttgccgctgaatacataatggagcgccgcccgtcagatgccgtccattcaaatctgtcgtgtttacccgagctgccgcggtgatgctgcagggcgcattgtgcgtcatccgccgagaagtgataaaacgaaacgccttcaccggaaaacagcgcctgattataggaaaatacgcaatcatatacagacaggccgaacccgtgcagatggctgagaaacagcagaaacgtttcatcgtccagcgaatcgagcaaggttaacagcggccgtttgaccgccttttcataacggatttcttccccgccgagcagggggatggtgtctgcgccgatttcggccgaaccgccgcaaatccgtgccggctgccatctgccgtcgcgtttcatcaatacgtctgcgtttccgagactgtctgcaagcaggatatcgccttcatcgttttcgacgaggcagatgccgtcctctatcatcagtgtgccgcgcccccatttgtttttttctgagaaaagctgttttcgtttcataaccgtgcccgtctcctttgtttgtttcttctcttccgttctttccaaatcgggcttgtctcatacaactcttagtgggacaaatcaactatctgcgtttctttgcataaactgggtaaagtgctgatagaaacgaatttgaaaccgacagaaacgggattggagctgatatcacatgtgtggaattgcgggttgggtcgattttcaaaagcagctcgtccaagagaaacatattatgaacaatatgatagacactctttcaaaacgagggcctgatgattcaaacgtctggggagagccccatgttttattcggacataaaagactttcggtcgttgacattgaaggcggccgccagccgatggcctgcacgcatcaagaggaaacgtacaccatcatttataatggcgagctgtataacacggaggaattgcggaaggagcttcaggcgaggggccaccgttttgagaggacctctgatacagaagtgctgctgcacagctatattgagtggcgggaggagtgcgtggaccgcttgaacggtattttcgcttttgccatctgggatgaaaagcgaaagcggctcttcggggcaagagaccggctcggcgtcaagccgtttttttataaagaacacggctcttcctttctgtttgggtcggaattgaaagccattcttgctcatcctgatgtgaaagcccgcacagacagcggcggacttgcggaagtattcggactcgggccgtccagaactccgggctgcggggtgtttaaaggaattcacgaggtgcgtcccgcccatgcgttcactttctcaaaggacggtttgtccatatggcgttattggaatgtaaagagcgaaaagcatacagacagcttcgatgaaaccgccgctcacattcggtacttatttcaggatgcagtgacacgccagctcgtatctgacgtgccggtttgcacgtttttatcaggggggcttgattcgagcgcgataaccgcgatagccgccgctcattttgagaaacaaggaagagatccccttcatacttattcaattgattatgaggagaacagcaaattttttaaagcgagcgcctttcagccgaatgatgacggcccgtggatcgataaaatgacaaatgcattcggcacacagcatcataagtgcgtgattacgcaggatcagctggttgaacatctggaggaatccgttctcgtcagagacctgccgggcatggctgatgttgattcatcgctattatggttctgccgggaaattaaaaaagattttgtcgtgagcctttccggagaatgcgcggacgaaattttcggcggatatccgtggtttcacaccgcggcagaagaagacggatttccttggatgaggtcgactgaggagagggtcacgctcttggatgaaaagtggcaaaaacggctgaatcttagagaatacgtgaatgcgagatatgaagaaaccattgcggaaacgccgctgttagacggtgagacgggaacagataaagcgagacggcagctgttctacttaaatatgctttggtttatgaccaatctgctcgaccgcaaagaccgcatgagcatgggcgcaagtcttgaagtacgggtgccgttcgccgaccacagacttgtggaatacgtttggaatattccttgggaaatgaaaatgcatggcagccgggaaaaaggcattttgcggaaagcgcttgaaggactgcttcctgaagatattttgtaccgcaaaaaaagcccttatccgaaaacgcatcacccgaaatacacgcagggggtcacagaatggctgaaaacgattttacaacagaaagattccgtgcttcacaccctgcttgacagaaagaagctggaaatgctgctggagacagaaggttcatcttttcaggtgccgtggttcggccagctgatgaaaggcccgcagctgatcgcccatcttgcccagatccatacatggtttgaggcgtaccgtatcgatatagaagaataacagtgccgcgaccggtttccgctgaaggatatcggtctttttattgtgaaacatatggtacactaaaaaacagaggagtgataccatgaccgaatacgaaacatgcgcccatcttgccgaggtgcactttcctttatataaacggactttctcatccctgccgccaaaaaacaggcgggccgcatgggcggtgcttgctttgtttcacgaagctgatcggcttgatatgcaggaacttgggggatttgaacaggcggcacaagactttctgaacggggcacgcgccgacggctttttgtgggaggcgctcactgatgtgcggcagcaatttgcacttgaagaagagccgttgcgtgagtttatcgccggccacatctctgacagagaaaaagtaacgtatcaagagtttgatgacctgctgatgtacgcgggccaaacaggcggagccctcggcctgcttctgctgccggtttgcgcgcgccggaaccaagagaaactccgccatgcagccgtttcattaggagcagccattcagctgacccgggtgcttctgagggtccatacggatgagtggtcgaaaaagcgtctcccgcgccaggtgatgatgcaattcggctatacggaagaagagctggagagccataccgtcaacaaagcttttatgaatgtatgggagtacatcgcattcgaggccgaggcgtatttcgaggaggcgtctgaagagctggagctgtttccgttatactcaagacccgccgttaccggtttgctggcacattaccggtcagagctcggtgacatgagaaaacggctttcgcaggcataaaaaaacgcccggcttcttaacgaagctcggggcgtttatgcaatccctttttgaatccaaatccgcgaccgccatcttctgtacataagaatgcctctgacccattcatccgcgataaatgaaatccagatgcccataagccccaatccgaaatggatgccgaacagataagcgagaggcagtccgataccccacatggaaatcatcgccatgtagacggggaattttgcatctccggcagcccgcagcgagttgatgataatgacattaaatgaacggccgggctcaagaatgatcgtcatggcgatcagcatgctcgccgtcgcaataatgtcagggctgcttgtgaaaattccgatcagctgctttgaaaacaaggtcatgatcacggatgtcaaagcggcaatgccaagcgcccagtacagacttttcatgcagcggtcataagcgtcgtcaaaccgtttggcgccgatatatctgccgatcaaaatctgtgtgccctggctgatcgccgttccgaacagcaggataaacatggtgatgttttgtgtataaacctttgttgtaagcgcctgagcgcccataatggcgataaaataagtgacaaccatttgtgaaatgttataagacagctgttcgccggcagacggaatcccgattttcaggagtttccgcaagtgctctttatggacgtgaaaaatcttttgccatgtcagaccgagtccgatgcgttttttgacgatcacaatcatcgcgatgagcccgatgatccgcgcaaaggacgttgacatcgcaacaccggcgacgcctaacaccggaaggccgagcggcccgaaaatgacaagaaagtttccgccaatatttaaaatattcatcccgatcgtaacgaacatcgtatccttcgtatgaccgtagctttttaaaatggcgctgaacgtcataatcaaagcctgaatgaaggacagcccgccgaccacctgcaaaaagactttggcatccggcatcaattcattggaaagacccatcacatgaagcagcggaacggccgcaaaaaatatggcggcgctgatggcgagactgatgacaaagttcgctcctattgatacataagccacttcctgcgcctcttttttctgtttagatcctaaaaactgtgaaatcacaattgtcgtacccgttgcgataaagctgaacatcacgataattaaatttaaaatctgattgctgacacccacggccgccacactgttgtcagagtattggctaagcataagagtgtcggcgtttcccataaacatatataatgaaacctcaataaatatcggccaagtcagcgcgtataatgagagtttgtgatcagaggattgtttgaatgcagcccgttttaaaatcgcttgtttcatttcttttaacccctttcctgaaaaaatcaacgtttaaaagtgtacctccattttcttataataaaaagggagagaaacgaaacttcttgcaaaaatccgacttaaaaaggagggccggaaatatgtcctttctcgagttcacagtccctccgttcccggtctttatcgctgcgggagaaggagtgttcaaaaaaggcgaaacccatgtgagacgggtcttcccggtgtttgatctgctgtatgtgaaagaaggcgtcctctacattacagaagacgaaaacgccttttccgttgaagcgggagaatatattctgctttctcccgggcttgaacattacggaacaaaaggcagtgaagaaacgacatcctattcgtggcttcattttgaaggagcggattatgaggtgacggaaaccaccgggaacaactggtcggagctgaggcgaaaaaaagggagctttgaagagccgtcccgctaccgcttgtccctgccgcaaaaagggaaggtgagacgcccgcagtttatggccgggcaattcagtgtgctgacagatgaaagcgccgagaactccgacctgccgctcagaaagcagattctgtttgaagagctgctgctccatcttcagaaagaagcgttccaaatcccgtccgcaaaggaaagagtcgcatgggaggccgcccggtacctgcaggagcactatcaggagaaaacaaccatcaaagcgctctcttcggcacttcattacaaccaagactacgtgacccgctgcatgcagcaggtgctcggcgtcacgcccggccagtatacgaacaaagtcagaatgacggaggcgaaacgtcttttgtccgcaaccaatgacaaaatgggggcgatcgcggacgccatcggcatggaggacccaacctatttttccaaactgtttaaacagattgaaggcatttcgccgcttgaataccgcaaattcgtaagccggaaaacggactgacctaataccagagaacagaagagggatcggtaagcatgaaaatgacaatttacgacgtggccgaaaaagcgggcgtctccatctcgaccgtctcgcgggtcatcaacaatacggggaggatcagtgacaaaacccgccggatggtgctccgtgtcatggaggagatggactatcatccgaatgttcacgcatccgctttgacgggcaaaaagacgaatatgatcggcctgatcaccccggacatttcaaacccgtttttcggggaactggcgaaaagcattgaagacagcgccggtgtacttgggtttcatatcattatctgcagcaccgattatcagcctgaaaaagaaacgaagtatttttcgatgctgcggcagaagcaggcggacggcattatattcgcgacgggacttgatcatgatgacagcgtcacggcgcttgatgatattgtgaaatcgggcatcccgcttgcgatgattacgcaggataaaccgctcgcgccgatggacgtcgtcattatcgatgactttctcggcggctatacggcggctgagcatctcatatctttaggccatgaaagaatcgcctgtatcgtcggaaacggttcgaccacgggtgaaagagacagaatcaaaggttttcaaaaagcgctgcgggaagcggggatgacactagatgaatcgctgatcataccgacggaatattcgctggaaagcggaaaacaggcagcgggcgagctgtttgacagagaccttccgaccgccgttttcgcctttaatgatgtcttgtcatgtgcggcgatacaggcggcgcgctcccggggcattcgggtgccggaagacttgtccgtcatcggctttgacaataccattctcgctgaaatgacggcaccgccgctcacgacgatttctcagccgatccgcgaaatggggcggcgtgtcgttgaacttctcattgatgagattcaagggaagaaaaaaacaaaaagcaaaatcattttatctccggaactcgtcatcaggcattctacggcaccggtaaaaacgcgccctcagcgataaggcgcgtttttttctgtgaaaaacattgtcaaacgagcgaaaagcattgtaaaattaaaacagcttttgagaaagcgcttgcgcaaatactgcggattgcaagcaaagaaagcaaacagcttgagttgtaaataaagcgctttcaaaataatgatttctgtttaataagagaaaccgcttgcgccattacggcatgcggcctcaagaaaaaaggagcggtgatagatgacagatcaagtcaggtgtgcggtgctgggattaggacgattagggtattttcatgcgaagcatttagccggcgaagtgcggggagccgagcttgcggccgtctgtgacccgatgaaggggaaggcggaagcgtgtgcgaaagaattaggaatcgccaaatggacggagaatccgtatgaactgctggaagatctcacgattgacgccgtcatcattgtcacgccgacaagcacacatgcggaaatgatcatgaaggcggctgaaaacggcaagcacatctttgttgaaaagccgctcaccctgagtcttgaggaatcgataaaagtcatgaaaaaaatcgaagaaacggacgtcatctgccaggtcggttttatgaggcggtttgatccggcatacgccgacgcgaaaagaagaatcgacgccggggaaatcggcagacccatttattataaaggatttacaagagatcaaggcgcaccgcccgcggaatttatcaaacatagcggagggcttttcattgactgctcgattcatgattacgacatcgcgagatatctcatgaatgccgaggttacgtctgtcagcgggcacgggaggattttaaagcacccgttcatggaggagtgcggcgatgtcgatcaggcattaacatatcttgagtttgattcgggcgcggccggcgatgtggaggcaagccgaaattctccgtacggccatgacatccgcgcggaaattatcgggacggagggaagcattttagtcggcacgctgcggaaaagccatgtcaccattttaacggagtcaggcagcagctacgaaattattccggattttcaagcccgctttaaagacgcttaccgtctggagcttgagcactttgccgaatgtgtgaaaaaaggggaaacgccgattgtgacagacatcgatgccgcgattaacttaaaaatcgggatcgccgcgacggaatcttttaaaaccggaaggcctgtaaagcttaccccgggcgcccccggctatgccggattatgatagattcgaagtaaaaaagcaaaggcccggcatgcctttgcttttttataattcatatgagaaaaaaatgtagtcagtcggcacgcctttatagcccatttggtgaagcatcgcgcttatattgccgcgatggtatgtgccgtgattcacaatatgccggatcacatcggcatatgtcgtccgaagcgttcccatgcgcggatgagaaatggagatcgggccttccatgttctccgattctcttaaaaattcgctgtattctttgtccagttcagtcattctatgttcaatcgcctcaaaatctccgtcaagcttttcaaattgatcaaactgcgagacgatttgttcgtaagtttctctgtaaagcacgtgaagccaagtgtaatcagcccggcatatatgcacaagcacggcgttcaaagtcggaaaaacactatccagttcctgctgtaagcttgccgcgggcagggtcttcagatgctgaataacttgctcattggcccatctatggtagtgatacagctttaaaatgtctgacattccaattccccctcttccttccggtacattcaacatgacctggccgaattccttttatcgaaacaaaagcgccgcaaaataaaaagcagcaccccacatcaccaatgccgagcattgattcaggatgccggggagccggccgcctgtatccgcggtttcgtttaataaaaaatcacgtcacgatggcgccgagcgcttctgcgaatgtaacggcatgagacggagagatgcggcatcctttcagcttatcaagcgagacgtgcagatgatcaaatgtgcacgtgctgatatccatattaaaaagagacgtgccgatgaagtttgcgccgttcaaatcacagacgtcaagatctgtgtattcaagaacagcatcattccactcactttctgaaaggccgcacgagtcaaaacggacatgcttcatattggaatagctgaaggagctgtaatttgcgaggcagtcttcaaaccgtacatgacgcatggcggaatccgccagattcaagccgagaagttttgaatgctgaaacgccgttctatggatgatgcttccgctgaaatcagcgtttgagacatcgcatttgtcaaacaggacatccgtacattccatatgtctgaaagagacatccgtaaaaacggtgtttctgaaaatgactttttcggcgcgcaggccgtccagtttgccgtttacgatgccgttttcaatgatgacttctttgagctcctcatcctgaagcgcttcagtgaaagaaagcaccggcaattctttcgggattttcggtttttggatcgtattcatctcatactcccttttctaaacataatagctgaaatcggcaattggcagatatcgttttcgcccctgcccacccttgccgaattgcgtgttgtttactgaacaaaggttaatatcaaagcgggatcgcgtcaatagcggcgcttataaaagcttcattccgtttgaacgtcatccggcacgccgaaagataacaaaacaaagcccttataagagatgccacgggcttttgcctgtttcaggcgagttctttatacatgatcacatgcgggccgatgccgggtatgtcaaaggggctgcccgtgcttttccagccgagcttttcgtaatatcccttcacgtgacatctggcgttgcaccagacaagcgccgcccccatatctgccagttttcgttccgcataggcgattaacgtgcttcccgctttttgcgtccggtattcttcaagcgttgccatgccgcgcagctggtaggcgggcgccgcctgtaaagcctgctggttctgcgggtagaaagaagcgatgctgatcaatgtcccgtcgtaaaaacctccgagatgaaatgctcctttgacgctgtcctgatcatatttacaatcctcaatcgtctgatgggggcgcagcacgctgtgtctgatcgcgtatgtgtcttctgcggtgatgggttttacttcaaccatgaaaaaatcctcctttgcttgattctttttctgtatcgtaccatgaaaaagccgcctgtcgtatcaggcggcatcttccgcgtcaatgcaaatatacatcagcccgcttttcatccttttgcttaatataagctgcaagttctgatgtcaaatcagaacggagaaacggggtgattaaataaattccgttaaacagttcgcacgccgtgtcgagaagcgacttggcgatggcgaggccttcggctttctgcttttgcttgtcttcgccggcgagcgccattttttcccggatgctgtctgacagcttaatgcccgggatttcatgatgaataaactctgcgttgcggctgctcgttaacggcataattccgatatacaccggtgttttgagatgtttcgtttcatgatgaatgtcaatgagctgctgctccgagtagacaggctgggacacgaagtagtcagctccgcactcgatttttttctccagccgttttaccgctttatcaagatggcggacattcggattaaatgctccggctacggaaaagttcgttttcttgccgagcggtttccctgataaagaaatgccttcgttgaattgtttaatcagcctgatcaagtcaaaggacgttaaatcatagacggaggtagcccccggaaagtcgccgatttttgaaggatcgcccgtgatggctaaaatgtcggtaagcccgagcgtatccagccccattaaatgtgactgaaggccgatgatgttgcggtctctgcatgtaatgtgaacgagagaacggatatcaaggcgttctttcagcaatgaaccgcaggcggcattgctgatccgcggtgtcgccaatgaattgtcggcgagcgtcagcgcttctatgccggtttcttttaattcagccgccgcttgcagaaatttgtcaaaattcaattttttcggcggatcaagctctacgataattgaccgtttttgagcggcgatttcgtttaaacccggctcggtccgttcattccggacggagatgacttcttcttcccgtctgattttcacttctttatcagtgacgggggaaagtccgcggaccgcttcagccatggctctgatatggtttggcgtcgtaccgcagcagccgccgataatgcgcgcgccctgagtgcggaactgtacggcgctctcccggaaataggcatcgtccgtatcataaacaagccggccttcttctaaagacgggaggctgctgttcggatagaccgataaataagtgtcacggaatatcggcacttcggtgagcgcttcaatcatgtggtacgggccgagccggcaattgattcccgttatgtcagcgccgagatcggcaattgacctgagggcttcccgaagcggcgttccgtcctgcagcacgccctgttcgtgcatggatacattcagcataatcggaagttccgtttcttttctcgctatcttcagcacttcgcgcgcctcttctaaatcatagtatgtttccaggagcagaccgtccggctcttcgtgaagcaataaataaagctgctcccgaaagctgcgtttaatctcctccaggctgtaggcgtttttgttaaatgtgcggatgccgcccatcgttcccaatacataagcgccgtctgaggaagcgcgcgcgattctgaccgcctcctgattgatttttttcgtttcatcctcaagtccgtatcttgagagcttaataaaattcgcgccgtacgtatttgtctggatgatgtctgccccggcttccacgtaagccttatgtatccgcttgatttcctcgggctttgatacgttcagttcctcaaaacatctgtcaatgccgtaggaatagaggagagtgcccatcgcgccgtctccgattaaaatccgttcttttaagtcttgtaatagtcccattgtttgcctccttcgtcacattcagcaaggaaaaaagagaaataaaaaaagtcttcttaagaagaagactctgtaatcatttgtctctcttcttatcttccaagctgtttttagcttgctggatttagcaccttggtcatggtttgggttaaaccattacaccggttgctgaagcgtcgtcgggccagtccctcggcttctcttgataagaacgttcatgtaattgtcatgggtttccaaaacttaactgtgaaaatccctttctccaaatttaccgaaaatagagacaataatcaataggaatcacataatttatctaaaattaataaattgaacgtcaatcggcaggtctgccccgcggacggctgcaataatctgctgcagatcatctttattttttccggtgacgcgcacttggtcgtcctgaatctgcgactttaccttcaagccggagtttttaatcaccgcgttgatttttttggcgctgtctttatcaatgccctgtacaagcttcgcgcgctggcgcaccgtgccccctgaggcattttcgattttgccgtattcaatgttttttgtcggcacgtcccgtttgatcagcttgccgctcagcacatctttgagctgattcagtttaaactcgtcatcagaaatcaggacaagttcttccttttctaaagttacatcgcttttagatcctttaaagtcatagcgcgtgccgatttctttcagcgtcatctgaatcgcattctgcacttcgggaaattcaactttggatacaatatcaaaagaactttcttttgccatgagaaaacctcctataacatttcacttatgagttgattatagtagaataaagagaaatgtccaactgcataaagcatgaatttatgcatattggaaaaaatgagaaaaacatcagccccatacgggcgaatcaggaaggacgataacatgagaccagggcagcagctcacgcttagtatagatcaccaaaccgatttcggttattttttaaccgacggcgaggatacggttcttttacataacagtgaaattacagaggatattgaagacagagatgaagtggacgtatttatttacgtcgatcatcaggaaagactcgcggcgacgatgaaaaagccgctcatcagcttttatgactacggatgggtggaagtgacggacgctgtggaggatatgggcgtattcgtcgacgtcggtctgtcaaaagacgcgctcgtcgcaacggagcacctgcctccgtacaaatccgtctggccgcaaaaaggcgacagactgtattgcatgctgaaggtgacaagccgcggacgcatgtttgccaagccggcgcctgaggatatcatcagtgaattatttacggatgcagaggaagacgtcatgaataaagacctgacaggcacggtgtacagactgatcgcatcaggctcttttctgattaccgatgaaggcatccgcgcgtttattcacccttcagaaagaaaagaagagccgagactcggcagccgcgtgacggggcgtgtcatcgaggtgaaggaagacggctccgtcaacatgtccctgctgccgagaaagcaggatgcgctttcggttgacgcggaggagattctgacctatctgagatcaagaaacggcgcgatgccttacggagacaaaagcgatcctgacgatatccgcgaacggtttcatttaagcaaagccgcctttaagcgggcgctcgggcacctgatgaaaaacggcaaagtgtatcagaaagacggctggacatacgaaaaacaataaattttctgcaaaaacatcggtgaaccaaaaccggtgttttttattttctcaaaagctcctatgccctcatttgtttatcaacctgccgaacatacatattttattgaaataaaatattctgacatccgaaccgatatataactatagaaaaaaacaaaaggagagtttcaatgagaaaaatggcgatatttgcggctgtactgctgcttgcgctcagcacggcgggatgtgccggcaaatccgagggggcggcggctgaaaaaacgaaaacaatcggcatcatgctgacagacaacggcctcggcgaccaatcatttaatgattcaggctttcaaggtttgatgaaagcaagagacgagctcggcatcacatttgattacagagaaataaaagacaccggtacgtacgaaaaaggactgacccagcttgtccgggaaggcaatgatcttgttgtggggctcggttacagcatgcaggcggatttagaaaaggtcgccaaaaaatatccgaagcagcggtttgtgctgattgattctgtatcagacctggataatgtcacctccgtcacgtttaaagaggatgaaggaggcttcttagccggagcgctcgcggctatgacgagcaaaaccggcacgatcggatttatcggcggttcagatgccgacgtcattaaacggtttaagaaaggctacctgaaaggcgcggaatcagtcaaaccgaacatccgcgtgctgtcggaaatcagcggtacgtttgatgatgataagctcgggaagcgcatcgcccaaaacatgatccgaagaaaagccgatgtcctgtttacggcggccggcttcacgggtgtcggcgcactgaaagaagcggaggcgcgaaaagtatacgccatcggtgttgacagcgatcaatattacaccgccgagcacgccgttatctcttctttagtgaaaaacgtcgaccatgtcatctatgaattggcgaaagatttaaaagacaacaaggagatcaaaagcggtgagatcgtttacggactgaaggaaaacggcatggacttagccaagatcagagttgtcaaaaacgcaggcgggctgacgaaaaagatcacggatatgaaaaacagtctgattgaaaaaggaggcgatctgaagtgacattacggacaaggctgctcgttaacgcagccgttacgatgatttgcttcgccgccgtcatcggctttaccatcgtaaacatgatgaagattcaggcttcaaatgaagatgaagtggacgcgctgttaaacgtccaggaagcaaaagccgaccttaatacgttaaaagaaagcatcaccggctattcctatacgctcgcagacgcccagaaagaagatgtacaaagctatatgaaaagcagctcggataaactggcggcgctcaaaaaaacgatgacggacgatgcggacaaagccgctaagcatgcggcaggcatcagtatgatggcgcagaccgtttccgacattgcgggccagaccaatctgctgtccttaaacgccgcaatcgaggcggccagagcaggcgaggccggaaaaggatttgccgtcgttgccgaggagatacggaagctcgcagacggatcagccaaagcgaccgcgcagattttcgatatggtaaagcaaattgaagacggcatcacatctattaccggagctgtcacgaccggcgtcgctttagcggacagacagcaggagctgatggagaaaacgtcagaatcattcgcccatattgaacaaaaagccgcccatattaaggcggagcttactcaattggacggacggatcatcgaatcgaaacagcttggtgagcaagtgctgcatcatgccgaaagcatcagcgccgtcgttcaggaaacggctgcaggaagcgaagagatttctgcctccgcgcttgagcagctgtcttcttttcataaaatggcggaaagcgtcaataatctggtgagcctgacagagcggttaaacgatcaggtccgccggtttactttgtaacagacatccgtgcgcaaaaaacagccctctttctcctaagacaagagggctgttttgcttttacagatggtccggttttttggaattctggttttttcccgcctgccggtttttttcggcaagccggttctttttctggtttacggcgttattgtccaacggttttttgtcatcatctttcatgcggcaaagcctcccttctgtccgttaggatgcccgcccgcattgaaattatggcttcaggaaaaaaatcgcgagcgtgcccggcccggagtgggcgccgatcgcagagccgattgaatgaagaatgatttctttcggatggaacgcttcttcaatcatttccttcatcccaatcgccgtctcttcattatctgcatagctgattcccacggtttgatccgcccaatcgccgccttcttccttcatcatttctataatccgtttaaacagtttcttctgtccgcgcaatttttcgagcggcacgagcctgccgtcatccacatgcagaatcggtttgatgttcaaaagccccccgacaaaagcggacgtttttgaaattctgccgccccgtgcgagataggcgacgtcatcgaccgtaaatatatgtttcatccgtgcgcaaaagttctttacagacgtttcgatttcttgtattgtattcccgttaacacagagtgtttgcgcgtgcatcaccgcgaggccgcagcccaatgaagcgcatttggaatctacaatccgtaaatcaaaatcgggaaattcctcttttacttcattggcgatcattacggccgtctgataggtgccggaaagacctgaggaaaaggcgatgtatatcgccggttctcccagttccgcgtattgtaaaaatactttttttatcgtatccggtgatgcctgggatgttttcggaactttcccttcccgcatcgcttgaaagatatgatccgcctgaatggtgaccgcgtcctcatattcgtttccgtcaagtgttacgtgcagcggaatgaacccgatccggttttcttcaatataagatttcggcaggtcagaggcgctgtcagcaataaggtgaactgtcatcataattcccttctttccggttggtgagagtgatgccaactatatcatataaatttggcaaaatagtgttcaaaactttattttaagggaaaagctaataatgaaaatgagcggaggagcaagccatggtactagaacaagtaaaaaaattagcaatcgtcgtcatcggcgcgtttctgtatgcggcgggactgaatttattcctgataccggcaaatgtatattccagcggttttaccggtgtcgcccagctgctgtcaagcgtcgttgatcaatacgcccccttttatatttcgacaggagttctcatgttcctcttaaacattcccatcggtgtgttagggtggctgaaagtcggcagatcattcaccgtatacagcatattaagcgtagcgctgacgtccgtctttatggggattctcccggaaatgagactgtcacacgatattcttctgaataccgtattcggaggagtcatctcagctatcggcatcggtttaacgctgaaattcggcgcttcgacaggcggtcttgatatcgtgtcgatggtgctggccaaatggaaggataaaccggtcggcacatatttcttcattttgaacgggattatcattttgacggcaggattattgcaaggatgggagaaagcattatatacccttgtcgctctgtatgtcacaacaagggtgattgacgccattcacacgcgccacatgaaactgaccgccatgatcgttacaaaaaaagctgatgaaatcaaagaagcgatttacgggaaaatggtccgaggcattacgacggtgccggcaaaaggcgcttacacaaacgaacagaaagaaatgatgatcatcgtcatcacgcggtacgaattgtatgaccttgagaaaatcgtgaaagaagtcgacccgaaagccttcacaaacatcgtgcaaacgacggggatctttggtttcttcagaaaagactgataggagcggatagaatgaagtggctgtttggcctgttattaccggtcattttattgatcggatgcagcagtcaatccgggcagaaggagcccgctgaggaggtatccggagagatgaatgaacagcaagcggaattagccgtaaatcctgtgcagacagatcagcagatcgaatttcaaatgtctttaaaaaacaaaagcgaaagcccgatcgatttcacattcagctcagggcagaaattcgaactgaccgtacatgaccaacatcacaaagaactgtaccgctattcaaaagacaaaatgtttacccaggcgtttcagaccgtgaccttaatgccgaatgaaacgtatgacttttcagatgtgtggaagaacgtgcccggtccgggaacatacacggtgacggtgacgtttttagggaagtccgatcagatcggaaaaagactgaaaacggtaaaaacatttgaagtaatataaaaaagcggcgccctcatctaaacggggcgcctttttttattgcaatttctccagctgatcctgaaattggtgcagctgctgacgttctgcatccgtcgaattggcgtacgcggaagacacggcatttttggcgcgtgagacagctttttcctggtcgccgtcctcgaaaccgttagcaatcatgacggcctgctggacaaatgacttggcttgagaaaacagttcgtttctcattaaaagtcaacctgcctttcagccgaatcttttgctgcatcatgctgtgcttcctctaatgtagaccgatatggaaatcttgcgtcatgaagactgacagagtccttgccttgctgaataaaccgttttgatttgtttcgtttacccattgcaatgtcccccttccatatttagacgagatgagtcgtctgttttagtatgggcggaaggctttgtgttatgagcgggaaaacctcacagggagaaataggattttaaaaattcggcgattccgtccgcttcatttgaacccgtgacgcgatcggcggcctgtttgacttcatccgtgccgtttcccatcgctacgccgcacccggcaaatcggagcatttcaagatcgttgtcttcgtcgccgaacgcgatgatccgttctctcggcacttggtaatagtcgctgattttcttcaggccgaccgctttattcatcccgtgtttaataatttcaatcacatgccaaggagccgcccatcttctgtggtcaatgacctcggcgtgcacatcggataaatgcgcgcgtatgtccgcgacgtcctcttccttcgcgtgaatcaatacggacgtcacatcctcttggaccgtttcgcgcagatcgccgaatgtgacattcgccgtattcatatgaaacgcctcaattaaatgctcatcatgataatggaagtacacatcatcaatgatctcagcgagcacattatgtatttggtaggtctctgtaagttcggcaagctgtctgaccacatcgacagataaagacgtgtggtatcgtccccatgactcgtctttcgggtggtggacaaacgctccgttaaaattgacaatcggcgttgtcagcccaagctcgtcataatacatcgaactggaacggaaagggcggccggttgagatgcagacatgatggcccgcttctttcagcgtctgaatcgtccgtgccgtttcaggggaaatggttttatcatcttttaataaggttccatccagatctaaggcgatgaggtaaggttttgtctccataaataactccttttgtcatataatttgctgtttttctcttatgtacagtgtagctttttaccatctttattgtctacatgttacacttatgattatggttatcctaaggagggagtcaacgtgattcttattgatcatcaaaccgtatcaggcattccgtttttacatattgtaaaagaagaaaatcgggaccgtcccgctccccttgttttctttattcacggttttacaagcgcgaaggagcataatcttcatttcgcttacctgcttgctgaaaagggtttcagagccgtgctgccggaagctctttaccacggtgaacgcgctgaacagctgtcagcagaagagctcgccgtccatttttgggacattgtcttaaatgaaatcgaggagcttgacgtgctgaaaaaggattttgaagggcgcggtctgattgaagacgggcggatcggtcttgcggggacgtcaatgggcggaattacgacattcggcgcgatggctgcgtatgattgggtcaaagccggcgtcagtctgatgggaagtccgaactatacggcattttttcagcagcagattgaccacattcaaaagaaggacatcgacattgacgtcacaaaagaacaggtcgatgaactgtttgcgcggctcaaaccgttcgatctcagtctggaaccggaaaaactccgcagccgcccgctgctgttctggcacggcgttcaagacaaagtcgttccgtatgcaccgacccgcggcttttatgaaacgattaaacctcattacagcagccggcccgaccatcttcagtttctgaaagacgaacgggctgatcataaagtcccgagatacgccgttttagaaaccgtcgcctggttcgataagcatttataaagcacaaaggtgttaacaaaagccgcttttgcgttatactgaggaaaaaggagtgatggaacgtggaagaagcattaaaagaaaacatcatgggcgccttggagcaggttgttgaccctgagctcggcgtcgatatcgtcaatctcggccttgtatacgacgttgatatggatgacgacggcctgacgcacgttacgatgacactgacatcaatggggtgcccgctcgctccgatcatcgtcgacgaggtgaaaaaagcgctcgccgacattccggatgtaaaagagacggaggtccacatcgtctggaatccgccgtggacaagagacaaaatgtcacgctacgcaaaaatcgcattagggattcagtaataagaaaatgcaccccggattttaggtacatcctaaagtttggaggtgcttttcttttgtctgcatataagcgacagtgagggcttgttttggattgcaaacaaacctttatatataaaatttcatatgaggtttatcttttttgtaataggacagtctgtcttggagtgtacctgtgcggaattcaaatttatgtccatcgggatcagtaaaataaattgacttttgatcttgcttatccctaggacgcccatttaatatatttacatttagattttttaacctttgaagtattgcatcaaaatcttttgggtcaattgtaaaggccgtatgcgtataggatttatgtatttcatttcttggtatatccgcctctaagttaagtgcaagccaaagcccgttcagatcaaaatatgctgttttttgccctttaaccagaagttgtgcatgaaatactttctcataaaattctatagatttttccaaatctgaaacagaaaaaagaagatgattgatcccttttatgttcattttccccacctcatttaacatctttgttttaaacaatccctttggtaatacatctgcatatatatcgattatatactgactaaaaaatcatttttagggatttctgtgtattttttatgcctggtgttttccggatgaccgttttgaactgtactaaacatgattctgccggacgcgtctgctttgtcgctgcagaccggcgtgcggaaagaagggcaagtcactaaaaaaaacaagtttcccgccattcggggttttttgcggtatcgggttaaaaaggaaaaaaacggacggaggcatgatataatagaccggctgcatgcgagggaggaacccatgaagaaaaaattacttctcattatccttagcattcttgtttatacggcgctgttcgctgtttccgcctttcacaaagagccggagcggcaggcagggacaatgacggatgtaagccgtctcatgcccgtgaaaattaagcagacggtcaaaggaaaagagaaagaaacattggtcgaaacgattaaggaagcaaagagaaagcatttgaagatctcaatcgcaggcgcccagcactcaatgggcggccagacgtattatgaagacggcatcgttctcgacatgacgggctacaacaaaatactcggtctcgaccgaaagaaaaaaatcatcagagtgcaggcgggagcgacgtggaatgatattcagcgctatgtcaatccgtacgggctcgcggtaaaagtcatgcaatcgcaaaacatttttacgatcgggggctcactgagcgccaacgcccacggccgggatatccggtacggttcgctgattgatacggtcaaatcgtttcatcttttaaaggcggacggcaaagtcatcaccgttactccgaaagatgacctgttttcagccgtcatcggcggctacggcctgttcggcgtcatccttgacgcggatattgagctgacggatgatgagctttatgaaatgaaaacgaaacgcatgaacgctgatacatacagtcaatattttacgcagcatgttcagcgcaaccccgccgtgcgcatgcatctcgcgcggatcgcaacaggggataaaggctttttgcacgatatgtatgtgactgattacacactctcagacaaccagaaagaattaaagcggcacaatgaactgaaagaagatgagcatccggcgctgacgaaattcgcgctcggcctctcccgccggtatgactggggaagaaattggttctggtcaacccagcagtcttattttctcagtcaaaacggcgtgaaagtctccaggaacaatgtcatgcggtcagaatcgaaatttttggaatatgaaaacacggacaacaccgacgtgcttcaagaatacttcgtgcccgtcggcgaatttgcaccgtacattcatgatttacgcaagacgctgtcacatgaagatctcaatctcgtaaatattacgatccgctacgtgcaaaaaaatgaaaaagccgatctgtcatacgcaaaggaagacatgttttcactcgttcttttaatcaatgaagggttttcaaaagacagccaggcgagtgcagcgcggattgtcagaaaaatgacggatacggcgttgcgccaccgcggcagctattatctgccgtatatgctgtatcaaacgaaagagcagatgcgcgaggcatatccgaaaagcgatatgttctttcagaaaaaacacaaatatgatcccgatgacttgtttatgaattatttttatcagaggtacaaatcatgaaacacaaccatttaaaatggctgatcctgtctcagagcagtgtcttttttgccggcagcctgatctttccgttttatattttatttattaaaaacatcggttccagctacactcaattcggtctatcatacggcttgttcggcctgagcggcgcattgattcatccgctgctcggccggctgtcggcaagactggatccccgctggttcctgatggcgaattcgtgggggatggcggtgcttcttctgacgctcccgcacattaccggcgtgcaccaggtttatgtggtgcaggtgcttttgggcctgttcggcgccatgcaaaaacacggcgagaaaatcatgatcgccgattacactgacggcggggagcgggggaaaaaagtcggcagctatcatttctggacggccgtattttcagctgccgccattattctcggcgggtttctcgctgatttcttcacggtttatattattttttacgccagctccgtgctgttttttataagcgggctgatgatgctgaaaaaaacaggctgatccgatcagcctgtttttcttatgaaaccccctcgatcgagagggggtttttgtcagcgaaaaccgatggaaaatgaatgaaaaaatattaaatatacaattgaattaatttttattcatgttataatgttaaataatttcacaaaaaccaagaaggtgaacccgttgaaaataggtattataggcgcgactggttatggaggcgccgaacttgtcaggattcttaaccatcacccttatgcagaagattgtatattatattcatcgagcgacgaaggaaaagaatatgccgcttcatatccgcatttgaggaatatagcgtcacaatcacttcagccgcttcatatagaaacgattcgaaacgaaattgatgtcatgtttatagccgcgccgcccggcgtttccggagagtggtcgcccaagctggcggaggcgggcatcccggtcattgatctatccggcgatctgcggattcaaaacccggccgtgtatgaaaagtggtataagcggaaggccgcgccgaaaggaacgattcaaagcgcggtttacggtttagccgaactgcaaaaagaagagattcagactgctaagctgattgccaatccgggatgttttccgacggctgtgctgctcgggctcgccccgctggcgaagaataagcttttacaagattcttttctgattgttgatgcgaaaacaggcgtatccggtgccggccgaaaagcatccatgggcactcattattctgagctgaatgataattttaaaatttataaggttaatgagcatcagcatactccggaaattgaacagcaattagcggcttggcagcccggcacaggtccgatcacgttttccgcacatttggcgccgatgacaaggggcattatggcgacgatatatacggaggctccccctggtatgtctgctgcacaggtaagagaattgtattccgaattctacaaagattcatattttgtcagaatcaggccggaaggtgaatttccggcgacgaaagaggtatacggcagcaatttttgtgatatcagtgtcaccgtggatgaaagaacaaaccgtgccaccatcgtttctgtcatagataatctgatgaaaggcgccgcagggcaggcggttcaaaatttaaatatcatgaatggctggcaggaagaaacgggacttacgatgacgccagtctatccatagaacgaaagagggattcgaaaatatgattcagctgagtgaggaaatcacgaaagtaaaaggcggcgtatcttcgccgaaagggtttgaggcaaagggcgtgcactgcggtctgcgctattcaaaaaaagatctcggagcgattatcagcgaagcgcctgcagtcagtgcggcggtatatacgcaaagccattttcaggcagcgcccttgaaagtgacgcaagagagcttaaaaaaagaggccgtgcttcaggcggttatcgtcaacagcgcgattgccaacgcctgtacgggagaccaaggattaaaggacgcctatgaaatgcgggacggcttcgcgagccagctcggcattgagccggagcttgttgcggtttcgtcaaccggggtgatcggcgagcttttagacatgaaaaaaattcaggcgggcattgaacagctcggtcaagcgccgtcagtgtccggagcatttgaagaagccattttgacgacggatacagtgacgaaacagacgtgttatgaactggtgatcggcggaaacatcatcacgatcggcggagcggcgaaaggctccggcatgatccaccccaacatggcgacaatgctcggctttgtcacaacggacgcggccgtggaagaacagtcgctcaaaaatgcgctcagagagattacggatgtttcatttaaccaaatcaccgttgacggagaaacatcgacgaatgacatggtgcttgtgatggcgaacggctgcgcggggaatgattgcctgacggagcagcaccctgactggccggcatttaaaaaggggttaaagcttgtatgcgaagaccttgccaaagatattgccagagacggtgaaggagcgacgaaattaattgaagccagagtcgaaggcgcgaaaaataaccttgaggcgaatattatcgccaaaaaaatcgtcggctcaagccttgtgaagaccgccgtttacggcacagacgccaactgggggcgcatcatcggcgccatcgggcacagtgcggcaagcgtaacggccgaacaagtggaagttttcctcggcggtcagtgtctgtttaaacacaacgaacctcagccgttttcggaaactgatgccaaggagtacttatcaggtgatgaaattacgattgcagtccgcctgcaggaaggctccggcagcggccgggcatggggctgtgacttaacctatgattatatcaaaatcaatgcgagctatcgcacatagcaaaggggagcggcatgaagaaaaccatcgtttttaagtgcggcggcagtgtaatccgcgagttatccgccgatttttttcaaaatgtaaaagagcttatgcaatcgggctggaaccttgccgtcgtgcatggaggaggcccggacatttcaagaatgctgaaaacattgcagattgaaacggaatttgtcgatggacagcggaaaacgaccaaaccggtgctggaaacagcggaaatggtcttgtcagggacgatcaataaatttttcgtaaccgaactcgcgaaaaacgggctgaaagccgcgggaatatcaggaaaggacggcggtctccttcaagcgtcttaccttaatcaagacaaatacggagaagtcggcgaaatacaaaaaaccgatccgtcaatcatccacgcattaatgaaagaaggcatcattcccgttatcgctccgctttccatgacaagtgatttcgaaacgctgaacgtcaacgcagacgccgcggcatcggccgtcgcttcagccttacacgccgataaacttttatttgtcacggatgtcgaaggaattatggacggagagaacaggctggatactttgacgccgcaagaaattcaggccctcatcgatgacggcgtaatttcaggggggatgattccgaaggtaaactcggcattatcggcactgagtgaagatgtcgaggaagtgatgatcgtaaacggaaaaggagcgtttttcaccaatcaagtcttccaaggaacaaaaatcgttaaagaaaaggagagcgtgtcatgagcagcctatttcaaacctacagccgctggcctatcgatattaaaaaagcgaaagggacaatcgcagaggatgaaaacggaaaaacgtatctcgattttattcagggcatcgccgtttccaatctcggccattgtcatgatgcggtgacggaagcggtgaaagaacagcttggcagcgtatggcacgtttccaatctgtttgaaaatgatcttcaggaaaaagccgcggcaaagcttgccggacatagcgcgggggatctcgttttcttctgcaacagcggagccgaagcgaatgaaggcgccattaagcttgcccgtaaagcaacgggaaagacaaaaatcgtaacatttcatcaatcctttcacggacggacctatgcggggatggccgccaccggacaagacaaaatcaagaccggtttcggaccgatgctccaaggctttcactatcttccgtttaatgacccgtcggcattcagcacactttcaaaagaggatgatatcgccgccgtcatgcttgagacggtgcagggagaagggggagtcaatcccgccgatccggaattcatcgaagccttacagacattttgcaaagacaaacaggcgctgcttatcgcagacgagattcaaaccggaatcggccggacgggcaaggcattcggctatgagcacttcggcatctctccggacatcatcactgctgcgaaagggcttggaaacggttttcccgtcggagccgtgatcggcaaaaagaagcttgccgacgcctttacgccgggtacgcatggtacgactttcggcggtaataagctcgccatggcagctgtgaaagcaactttggacattgtgtttcagccggactttctccaggcggcggcagacaaaggctcttttttaaaagcgcagctgaaccgtgaactgacagggccttttgtaaaagaaatccgcggaaaagggttattaatcggcattgaatgcgcaggtcccgtgtccggcatcatcggagatctgcaggaacgcgggcttctcgtgcttccggccggaccgaatgtcatcaggctgcttccgccgcttacggtttctgaagaagaaatgctgtcggccgtcagtatgctgaaagcagcgatcgaagcgcattcggcagtgaaacggtaatttttttcgatataaaggtataaaaattcatatttttaattaattattcatcaagaggtgggctttagatgaaaggctatttagtattggaagacggaacatcattcggcggtgaacttgaaaaagaggcttgctgtgttggcgaagctgtttttttcaccggaatgacgggctatcaggaagtgcttacagacccgtcatataaggggcagatcatcgtctttacgtatccgctgatcggaaactacggaattaatgaaaaagaccttgaaagtaaaattccacaagtcaaggctgttgccgtctatgaagcgtgtgaacatttttctcaccatgaagcagtctcaagcttgagagagtatttaaataaatggaacatcccgctcttaaccgaagtggacacacgggccgtcgtcaaagccatccgctccggcggcacgatgaacgctgctgtgtcaacagcaggagaaattcccgcagcatccggaacacaaaatccggcggagctggcgcagtctgaagacatcacttcaatggggaacggagaccggcatattgcgctgattgatttcggttataaaaaatcaatcgcctcgtcacttgtaaagcgcggctgtaaagtaacggtcattccgtatcagcagatggatgccgtttatgacattcagcctgacggaatcgtgctctcaaacggcccgggcgacccgaaagcgattgcgccgtacatgaaccggattacatctttactcagtgatttccctgcactcggcatttgcctcgggcatcagctgattgccctggctttcggaggaaatacgtataagctgccgttcggccacaggggtgccaaccatcccgtcattgaccggaaaacgaaaagggtgtttatgacaagccagaaccacagctatgtcgtcgatgaagcgtcaattgacgaaaacgagctgtccatcagatttcaccatgtcaatgatacatcagtggaagggctcattcataagcgccttcccgtattaagcgtccagttccaccctgaagctcatcccggtccggctgagagcgagtggatatttgatgaatttctagagaaagtgataccagcaaggagagaaatcgctcatgcctaaagatacaaccatttccagcatattagtcatcggctccggccccatcatcatcggccaggcggctgaatttgattattcaggaacgcagggctgcatggctctgaaagaagaaggataccgcgttattctagtcaataacaacccggcaacgattatgacggatgaggcgtttgccgatgaaatatattttgaaccgctcacaaccgacagcatcgaggccattattgaaaaagaaaagcccgacggtctgcttgccaatttgggcggccagacggcattgaatttagccgttaaacttgaagaagcaggcgtgctgaagaagcatcacgtcaagctcttaggaacatcggtggaaaccattcaaaaaggcgaagaccgggagcagttccgcgccctgatgaaagagctcgaccagcccgttccggaaagcgaaatcgtcgacaacgaagaagacgccctccgcttcgctgagtctatcggatttccggttattctgagaccggcgtacacattaggcggaaagggaggcggaatcgcgaaaacgaaagaatcgtttcagacgcttattaaacaggcgctgttagcaagcccgatcagccaatgcctcgtcgaaaaaagcatcgccggatttaaagaaatcgaatatgaggtcatgcgcgacagcaatcatacatgcatcaccgtctgcaatatggaaaacatcgatcccgtcggcgtgcatacaggagactctatcgtcgtcgcaccgtcccagacgttaacggatgaagaatatcagatgctgcgttccgcaagcctggcgattatttcggcgctggatgtggtcggcggctgcaacattcaatttgcgctggatccgttcagcaaacagtactatgtcattgaagtgaacccgcgtgtcagccgttcatcggccctcgcgtcaaaagcgaccggctacccgattgccaaaatggcggcgaaacttgccgtcggctatacgctcgacgaactgaaaaatccgctgacgggctctacttatgcaagctttgaaccggcgcttgattatgtcatcgtcaaattcccgcgctggccgtttgataaatttaaacatgccgaccgcacgctcggaacgaagatgaaagcgacgggagaggtcatggcgatcgaaagaaatatggaagcggccattcaaaaagcggcggcctcccttgagctgaaaacgatcggcacccgcctgcctgaactcggcggctgtacgatcaatcagctgtgggaattagcggtaacgccggatgaccggagatttttcgtcgtcatggaactgttaagccgcggtgaaacgatagaagatatccatgccaaaacgaaaattgacccgttttttctccatgtattccgaaatatcatcacattagaaaacaagctgatggaagaaggggatcatctgtctgtcccgcttttaaagcaggcgaaggtaaaaggcttcacggatgtcatgatcgcatctctcacgggaaaaacggaagaagacatccgtgctctcagaaagaaatcaggcatcgtcccgtcgtttaaaatcgtagatacatgcgccgctgaatttgatgccaagacgaattatttctactccacctaccttggggaaagcgacggagatgtcagccgaaaagagaaaaaacgcgctctcatcatcggctcaggcccgatccgcatcggtcagggagtggaatttgattacagcgccgtccacggcgttctgaccctgcaaaagctgggatatgaaacgattatgatcaataacaatccggaaacagtaagcacggattatgaaatcgccgaccggctttattttgaaccgctgacgacagaacatattttaaacgtggcggaacatgaaaacattgattttgccatcgtccagtttgggggacagaccgcgatcaatgccgctgaaccgctggaaaaagcgggcattccgctgctcggaacatcctttgaaacccttgatgcgctggaggatcgggatctgttttatcagctgcttgatgatcttgacctcaaacatgccaaaggcgaaacggcttattcaaaagaagaagcaactgaaaaagcaagccgaatcggctaccccgtgctgatccgtccgtcttatgtcatcgggggatgggcatgatcatcgttcattcagaagcgcaaatgtcagagctcctggaaaaagaagcgggcatgccgtacccgattttgatcgatcagtacattacaggaaaagaattggagatcgatctgatttccgacggacatgaagtattcgtgccgacttacacagagcacattgaacgggccggcgtccattcgggcgacagttttgcgattcttccgggtccgtctgtcacacctgatatgcagcggaatataaaagaggccgccgaaaaaatcgcggtaaaactggcttttaaaggcattatgaacattcagtttgtcattgatgacaaaggggatattctcgttcttgaagtgaatccccgggcaagccgcacggttcctgtcgtgtctaaggtgatgggggtgccgatgatcccgcttgccgccagattgctggccggcgcttcccttaaagacatcaagcccgaggttcaaaatcagcacggaacggcagtgaaattcccggttttttcttctcacgccattcaggatgtggacgtaaagcccgggccggaaatgaagtcgaccggagaaggcatgtgtgtcgcgtttgacgcagaaagcgcactgaaaaaaatctacgcgcacgtctgggagaaaaaaggcagcatctatctggaaggctgtgatgcggaattggaacgtcaggctcaagaggcgggatttaccgtatgcaaagatgcgttcccggcatgggcagagcgaaaggataaagcggtccatattaatttcaatcactctgaagaagcgcgtaaacaacggatcgaagccatgacgcacggtgtgacggtctttactgaaccggaaaccgtaaaggcatttttagcaagcggctccggcaaacctcagcctgtatcgctcaaagatctttatcaaaaggaagtggcatcatgcacacaataaaagcggaacacacattaacccatttgtacggcaaagattttctttcattaaaagatgtcagcccgtcagacatcaatgcgcttctgacagaagcttcattattaaaacaacatccgatacagccgattttccaagggaaaacattggcgatgatttttgaaaaatcttcaacccgcacacgtgtgtcttttgaagcgggaatggcccagctcgggggaacgggactatttctttcaagcagcgacctgcagcttgggcggggggagacggtcgcggatacggccaaggtgctgtccggcttcgttgatgccattatgatccgcacctttgagcatgaaaaagtcgaagagcttgccgagcatgctgatattcccgtcataaacgggctgaccgaccggtatcacccgtgtcaggcactcgcggatctgttaacaatacaagaaataaaaggaaaattaaaaggagtaaaagtcgcctatatcggtgacggaaataatgtcgcgcattcacttatgatcggctgcgcaaaaatgggctgtgacattgcggttgcttcgccgaaaggctatgaagcagaggaagaggcggtgaatgccgcgaaagaagcagcggctgtttccggagcgaaaatcacccttaccgaaaatccgcaggaagcggtgcgggatgcagacgtgatttactccgacgtcttcacgagcatggggcaggaggaagagacgcagcagcggctgaatgtgtttgctccgtatcaagtcaacgcctcactcgtcagtctcgccaaacccgactatacatttttgcattgcctgccggcgcatcgggaagaagaggtcacgtccgagattatcgacggcacgaactctgcggtattccagcaggcggaaaaccggcttcacgcgcaaaaagcgctcctgaaagctcttctatacaaacaggatgaacaaaaaaaccgctgaatctcattcagcggtttttgatatttctccgcatacaagcgcatactacataaaaaagaaaaaggaggaaatgacgtgggacagcagcatcaattccgcccgggacaaaaagcgccgaataacggtgtgtacgttgaaatcggcgaaacgggaagcatggtcaaaaatccgcaaaaaatcaaacttacggtgggagaaatgttccctgaaacttcaaaccacaacagattgtggacgtaccaacgaaaaccgtgaacacaaaaaaacctgctgaatagcaggttttttatttaatgctggtttgcatcctgtttgacaggcatgatctccgcaagaacaaagactagcaccgcaataaccacggcaataacggatgattgcttgaaattgtacgccgcgctgttcatggaggcgaccaaataacaggccatatgtgttaaaaggaacgtccaaataaaaccgataataaaccgcacgtttccacctcgtccttcattttattctacgttgtatcataccatacataaagcgcgggcggaaggtcattttctcatcaaaaagcgcgcctgaaactgacatgtgcccgcctgtcttgccgtctgacggaaaattcggttcctgtgcttgggataatagccaaaacatagcagcaaataggagtttatccgatccgttttcattcttcttacatatgatagccaatagagagattaggagtaaaaggaggcgggcaggcatggggataacggaaagatttttccaattcggatctgagctgaacgtcatccatctgccgtatcggccgaacggcttctgtatctttattctgggggacagaactcactttgtcagccgggactcaagcttttggctcgaacatgaagggagaaaccagctgttaaatacgctgcttgacagagggtacaccattttcaacagcaatttatacggacggcattggggttcggaaaaagccgccctttacgccagacagctgattcattatgtgctgaaacaagaaaccctcaatccgaaaatacacttgctcgcagaaggcatgggcgccctcatcgccgatcaattgctgcagtcttcaccggagcatatccgttcagccgcaatgttagatccttgtctggaccttcaagcccattttgaatcagagaaagaaaataagtttttttataagcagtttctgagggaaacggcacaaagcttcggtgtttctgaaaaagaggcaagctcactgagctatcagaccattaccggctgccgcacccgcgtgccggtacatatatggcaaagaacgaccggagcgccgtacccgtacaccctgcacgcgaacgcgtataaagaagcccgggaaaagaccggaagcaagattgatatcacgtatcacctgcttgagaaccctgctcgtatgtacagagccatctgccggtttttccgcagtcatgaaaaagacctgtaatgaatagaatacaacagccatctcttttcagagggctgtttggcttgtgtgtgtatgaaaaaccggaaaggcggcagatgtgatgaaaacagcgctgatcattggagcagatgaatttctcggcctttcattgtgcgaacggttgatggatgaaggtgtgcacgttgatgtcattttggcagaaccggaggacaaaacgaggcagctgtatttagaagaacgtttaatgtggctcgcgagaaacgggctttttcaaataatagaggaaatcggtgaaaaggaatacgatcgtatctgcgttcaatacgggagcgggtgtctgcctgaaaaaagggctgagcctttatattggattgtttacagtgaggatcacggagactgggaaaaaaacggtcagcgggatacggcaaaagcgattatccttcctcccctttacggtccgtggacggaagcaaaagaagatggagaaagcaggatctttttagaagacgcggtctgggggctgatgaataagcttgaggctgacggcacagaagacgaaaatcagattattaccctggaaataaaagaaaaaacgcaaaaaacggaagcggaagaaaaaattaaagaatggaaaagacaattttcatcaatattcgacattttttaagaaataccttccatgttatgtgcattaccgctacaataaacgtatatcaattatacatgttatgagtttgaaaaggggttgaacatggcttgatcaccaggcttgtcatgatcttttctgtcctccttttattgagcggatgcacacaaactccgtttaaaggaaaaattgagaaggtcggaatgcttttccccgataccatcagtgacttggtatggggcacaaaaggttacaaaggtttattagcgatacaatctgaatttaacgttgacgtttattataaagaaaatatcagatccgatgaagatattttaaaagcgatagatgattttcataaaaaaggagtcaatcttttatacgggcacggaaatgaatacgaggaaatcttcaatatgatcagcaaggattatcccgacatggaattcgtcgtcgcaaacggaacggcgaaaagcgataatgtcacaagcgttcaccttatgggagaagcaatgggttttttcgggggaatgacggccgcccatatgtcaaaaaccaatgaggtcggtgtcatcgcctcctttttgtggcagcctgaagtagacggctttatcaaaggggcgaaatatgaaaagcctgatatcaccgtcaatactgaatttacggaccactgggataacggcaatgaagcgctgcatctttacgagaagttaaaagcggagggcacggatgttgtatatccggccggagacgggtataatgttcctgtcattcagcaaatcaaaaaagacgggctttacgccatcggctatgtcgccgagcaatcgaatctcggcaaaaacacggtgctgacaagcacggtgcaaaacgtagataaagcctatacattaattgccgagcaatataataaaggtacgctcaagagcggagatcacgactttgatttcagggaaggagtcgttgaaatggggacgttcagcccgctggtggacaaagcgtttcaagacaaaatctcagaccttgtcaaaacgtataatcaaacaaatgaactgccgtcaaatgaatagaggtggatacacatgcagcatgaaaagtctcttgaatttatgcagatcgcgatgaaatacttgccggaagcaaaggcggagcttgagaaatccggcatagatctgtctatggaaatgattcagccgtttatggacctgtttacatcggtcatggcggaagcgtatgagcttggcagatctgatgccggggagctgaataaataaagagagccactttttcatgaagtggcttttcacatgatttttttctttatggcggacaccatcggcgcaaagtctttaaatacgggctttaattgatccagggagttcatgatggaccccagctgattcaacacgtggttgtaatcgatctcttcttcgttttcagcctgaggctgctccgggttttcttccggttctttatcccggtctctggaatcgccgaacatcattttggagaaaatatccatagtgaagcctcctttcgtcttccttttattctatgaggagcagcgtccgatagtttagacgaatatattgccaacagaaaaaaaatagggtagaattagtacctgatactaataattgatcataactaattagttttaaattcattataaaaaaggagtcttttccaatgaaagctggaattcttggcgtcggccgttacatcccggaaaaagtgctgacaaatcatgatcttgaacaaatggtagatacatcggacgagtggattcgtacgagaacaggtatagaagaaagaagaatcgccgctgaagatatgtattcatccggcatggccgctgaggctgcgcaaaaagcgcttgatcaggccggcatttccgctgaggagcttgatatgatccttgtggcgacggttactcctgaccagtctttcccgaccgtttcctgtatgatacaagagaagctcggggccaaaaaagcgtgcgcgatggatatcagcgccgcatgtgcgggttttatgtacggtattgtaaccgccaaacaattcattgaatcgcaaacatacaaacatgtcctcgtggtcggcgtggaaaagctctcaagcattaccgactgggacgaccgtaatacggctgtgctgttcggagacggagccggagcggcggtcatcggaccggtcagcgacgacagaggcatactttcatttgagctcggagcagacggtacaggcggtcagcacttgtacttagatgaaaaagggcatacaatcatgcatggaagagaagtattcaaattcgccgtccggcaaatgggtgaatcgagtgtaaatgttattgaaaaagccggcctctccaaagaggacgtagactttttgattccgcatcaggcaaacatccgcatcatggaagcggcacgggaacgtttggagcttccggttgaaaagatgtctaaaacagtccataaatatggaaacacatccgcagcatccattccgatttcattagtagaggaactggaagcaggcaaaattaaagacggcgacgtcatcgtcatggtcggtttcggcggaggattgacatggggcgccatagcattacgctggggacgataaaaaaaggtgaggtgcacacaagatgagtaaaaaaagagtagtcgttacagggcttggagccttgtctccgcttggcaacgacgccgaaacaagctggaaaaatgcaatcggcggcgtatccggaatcggaccgatcacacgtgtggaatcggacgagtatccggcgaaagtagctgctgaattgaaagatttcaatattgaaaatcacatggataaaaaagaagcgcgaaaaatggaccgcttcacgcaatacgctgtcgtagccgcgaaaatggccgttcaagatgccggtctgaacatcacagacgagatcgctccgagagtcggcgtttgggtcgggtccggaatcggcggtcttgaaacgcttgaatcccaattcgaaatcttcctgacaaaagggccgagaagggtcagcccgttctttgttccgatgatgattccggatatggcgacaggccaaatctcaatcgctctcggagcaaaaggagtcaactcctgtacggtgacggcatgtgcgacgggaacgaactctatcggtgacgcgtttaaagtcattcagcgcggcgatgccgatgcgatgattacgggcggaacggaagcgccgctgacaagaatgtcatttgcgggcttcagcgcaaacaaagccctttctacaaatcctgatccgaaaacggcaagccgcccgtttgataaaaaccgtgacggctttgtcatgggagaaggcgcggggatcgtcgtgcttgaagagcttgagcatgcccttgcccgcggtgcgaaaatctacggggaaattgtcggctacggctcaacgggtgacgcctaccacattaccgcgcctgcccaagacggggaaggcggtgcgagagcgatgcaggaagcaatcaaagatgcgggcatcaagcctgaagaaattgattacatcaacgctcacggcacaagcacgtactacaatgataaatacgagacaaaagccattaagaccgttttcggtgatcatgcgtacaagcttgccgtcagttcgacaaaatcaatgacgggtcatttgttaggcgctgccggaggaattgaagcaatcttctccgtcatggcaattaaagacggcattatcccgccgacgattaacatcgaaacacctgatgaagagtgtgatttagattatgtaccggataaagcgcgcgagcaggatgtcaacatcgttctcagcaactcgctcggcttcggcggacataatgccactttgatctttaaaaaatatcaataatacagtttttgaccggctgcctgaaaaaggtggccggtttttttgtgcgtgcatatgataacaacaagaggaggcgaaccggtatgagcgtcaagcagacatatcaatggatggaaaaggcggcatccgtaaatgacctggccccgcatcttttgccgcttttttcaggggccgataagaaagagtggaagccgatactcgggatgctgcaaaaccacggcatgttccgccatctgaaggacggcgttaggaccagtaaacggctgaaagaaaaaggatgctacagccatatacaaaaagaggaagcctatttaaaggagaagtggaacgggccggacgtgccgatcgtagttttgcccgttgatgaacgaaaccggaaaatccgtcaggaattcggatcaaaatccggtctggcctttcgggacaaaatgttcctctttctatcgtcggatagttccaattcagctgtatccgcccttatgacacatgaatataatcacgtctgccggttagaacatgtgacaaaggacgaaaaagatgagacatttcttgatacaatcatgatggaggggctggcagaatatgctgtatatgagcggttcggctcaagtcttacggcggaatggacgtcctactatacgcctgagcagcttgattttttgtttgaaaaaagagtcaagccgaacctccgcttaacgagagacagcagaatgttttcccagctgttatacggaaaaggatacttcccctcaatgcttggctatgccgtcggattcaatatagtaaaaaaatatttaaccgaccatcaaaaaacagtaaaagaagcattggccatcccttcaaaaacctttctggaagcaacgctttaatagattaaaagaatggaaattatttaaggatattacatttatcctaaaaaattcttgcttttgtaataatgatgtaataatatacaactataaaatttttcgactattctatattttgtgatagcgaaacgtatgtttccctctgcttcagcggaatgagaaaggggcgtatcatgagcacactattagaagtgaataatttaaagacctattttttcagaaagaaacagccgatccctgcagtcgacggggttgattttcacattaacaaaggcgaaaccgtcgctcttgtaggagaatccggctcgggcaaaagcatcacctcgctttctattatgggacttgtccaaagctcgggcggaaaaattatggacggctcgattaagctggaaggcagggacctggcctccttcaccgaaaacgaatattgcaaaatccgcggaaatgacgtctctatgatctttcaggagcccatgacttccctgaatccggtgctgaccatcggcgaacaaattaccgaagtgcttgaataccataaaaaaatgaataaaaaagaagcggctaaaaaagccgttgagcttctggaactcgtcggattctccagagcggaacaagtgatgaaagaatatccgcaccgtctttccggagggatgagacagagggtgatgatcgccattgcgctcagctgcaatccgaagcttctgatcgctgatgagccgacgacggcgcttgatgtgacgatacaagcccaagtattggagctgatgaaagacctctgcaaaaaattcgatacttctattctgctgatcactcacgatttaggtgtggtttccgaagccgccgacagggtgatcgttatgtattgcggacaagtcgtagagagtgcgggtgtggaggacttatttttaaaccctcttcatccgtataccgaagggctgttaaactccataccggtgatagatggagagattgatacattaaaagcgatcaaaggcagtgtcccgacaccggataatcttccggaaggctgccgattcgccccgaggtgttcaaaagcgatggacaaatgcaaaacagggcagccggagctgataacgcatgaaagcggccgttctgtaagatgttttttatatgaggaagagggtgcccaatcaaaatgacagctgcaggccaagaaacgattttagagctgaaagacgtaaaaaaatatttcccgatccgctccggtttttttcaaaggaaagtcggtgatataaaggctgttgacggcgtttctttttcactgaagcgcggggagacgctcggcatcgtcggtgaatcaggatgcggcaaatcaacggcgggaaggacgatgatccgtttatacaagccgacagacggccggattctctttaaggggcaagatatctccggcttatctgaagaaaagctgagaaaaagcgtccgcaaaaacatccagatggtattccaagatcccttcgcatcccttaacccgaggaaaacgctgcgttccattattaaagagccgttccagactcaccatatgtacagcatgagcgagcggaacgagcgagtggaggagctgctggcgaaagtcggccttcacccgagctttgcaaaccgctatccgcacgaattttccggggggcagcgccagcggatcgggattgcgcgggctctgacgttgaatcccgagctgattattgcggatgaacccgtttccgcactcgatgtctccattcaggcccaagtcatcaatctgatggaagaactgcaggatgaattcaacctgacctatttgtttatttctcatgatttgagtgttgtccgccatatcagcgacagagtcggcgtcatgtatctgggaaaaatgatggagctgaccgataaacacgagctgtacggcaatccgcttcacccttatacgcaagcgcttttgtcttcagtgcccgtcacgagaaaaaaagacgccgtcaagcgggaacgaatcatcctgaaaggagaactgccaagcccggcaaacccgccgaaaggctgcgtgttccacacgcggtgcccgatggccaaaccgatctgcaaggaacaaatcccggcatttgaagaagccgctcccggccattacgtcgcctgccatttatatgcctgaaatgacaagcatcgagagggggtatgccggattacataaccagtttgctgcatatatatcacaaagggggaattgatatgaaattacgtaaaagcgcactgatgatgctaagtgtttttatggcgctcgccatcttcctgtcagcctgctccggctcaaaatccacaagcaccgaatccaaaccggcaggaaaaccgcaaaaaggcggagatttggttgtcgggtcaaccggggaacccacactttttaatccactttattctaccgatgttgcaagttctgatattgaaggcatgatttacagcacattattggaaacggatgagaaattaaacgtcaagccgtcgctggctgaaaaagtaacagaagctgacgggggattaacgtatgatgtaaaactgaaaaaaggcgttaaattccatgatggaaaagagctgacggccgatgatgttgttttcacctacagcatccctcttaacaaggattacaacggtgagcgtggctcgggttttgagtcccttaaatccgtaacgaaaaaaggaaaatatgaaattcagtttaaaatgaagaaaaaagatgcctatttctataatgtcgttctcgacagttacggcattttgccaaaacatatattgggtaaggtgccggttgcagatctgggagagaatgaatttaaccgtaaaaatccaatcggctccggtccgtttaagtttgttgagtggaaaaaaggtgagtatgtcaaactggaagcaaatgatgattactttggcggcagaccttaccttgatacagtgacagtcaaaacaattcctgattctaacgcggccgtggcccagttaaaagcgggagatattgatttcttcgttgtgccgggcacagattttgatacggttaaaacgtttggaaacgtgaaggtcaaatctgatctcggcttaaactacagctatatcggctggaatgagaaaaaagagctttttaaggacaaaaaagtgcgtcaggcattgacttacgctcttgacaggcaggcaatggtggatcaagtgctgaacggagacggtaaggtagcggatgttcctgagagtccgctgtcatggaattatccgaagtctaaagtgccgacatttgattataatccgaaaaaagcaaagcagctgctaaaagaagccggatgggaagaccatgacggtgacggctaccttgataaagacggaaaaaaattctcatttgaaattaaaacgaatcaaggcaataaaattcgtgaagatttagctgttgtcgttcagcagcaattaaaagaagtgggaatcgaggctaaaccgcgaattgttgaattcagtgcgttaatcgaacagacaagtgcccctaattgggattatgacgctcttcttctcggatggagtcttgcaacgttcccggatcaattctctatcttccattcaagccaatcgaaaaacgggctgaataatatctggtataaaaacccgaaagtcgataagctgcttgaagaagcgaagtcaattacagacagaaaagaataccaaaagaagtatgaagagatatacaaattaattgctgaagatcagccgtacagcttcttattctattacaattaccacagagcgatgccgaataatttacaaggctatgtattccaccctaaaaatgacttgtacaatattgaaaaatggtggctggatcaaaaatagcaaaagccctggagagggaaggaggttcctttcctctcttatcctatttaaaaaggggacaagaatatggttacatatattttacggcgaacattaatgtccttgccgattctcttaggcattacaattttgtcgtttgccatcatgaaagcagcgccgggagacccgatgtcacttatgatggaccctacaatcagtcaagcggacagggcgaaattcattgaaaaatacgggttgaatgatccggaacctgttcaatatgtgaaatggctggggaatatgctgcaaggggattttgggacttctatcgtcaagaaaggcactccggtttctgaacttatcttatcccgcttaccgaatacgattgtgcttatgcttttctcaacccttgtcgctcttctgatttctattccatttggtgttctgtcagcgaaacgtccttattcaaaattggattacgggataactgttacttcatttttagggcttgccattccgaatttttggttcggtttgattttaatcatggttttatctgtaaatctggggtggtttcccactggcggagtaagcactttgaatgctgactttaacatatttgaccgattgcatcacttgattctgcctgcttttgtgctcgccacggcagacatggcagggataacgagatacacaagatccagtatgcttgatgtgttaaaacaggattatatacgaacggcgcgtgcgaaaggattccgagataataaagtgatttttaaacacggtttgagaaacgggcttcttcctgtcatcactatttttggtttgatgataccgtcatttatcgggggagcggtagtggtagaacagatttttacttggccgggtctcggcaaattgtttattgattcagccttttcgcgggattatccggttatcatggccatgacggtcatttcagctgttttggttgtagtggggaatttaattgcggacatcttatatgcgctggttgatccccgcattgaatattaacaaagagaggtgagaggtcaaatgttacagccaaataccggcacaccccccagcgaagtgaaattaaaggaaaatattcaatccaaaccggaaacaatgacgaagatttttttcgaaaagttctttcaaaataaactagctgtaatcggagccgttatattaaccatcattatcttgtcagctttattcgcttcggtaatcgctccttactctccggagagtcaatctctcatcaatcgtttgaagccgccgagcttaaaacatctaatgggaactgataaattcggaagagacatctttacgagggttctgtacggggcgcgcgtctccttgcttgtcggattcgcttctgtgatcggcgcgattacaatcgggacagttgtcggagccgttgccggatattttaaagggtttgtcgatgccgttctcatgagaaccgttgatatcgtattatccatacctgatatatttttgttaattacacttgttacgatttttcagcccggaatggataaattaattttaattttctcccttacaggctggacaacaacggcacgccttgtccgaggagagtttttatcgcttcgttccagagagtttgtattagctgcaaagacgatcggtacaaaaaaccatcacatcatcttttctcatatactgccgaatgcgctcggaccgattatcgtctcagccacattaaaggtgggaacggttattttggcggaatctacattaagttatctcggtttcgggattcagccgccgatcgcaagctggggcaatatgcttcaggatgcacagaactttacgcttatgatacaggcttggtggtacccgttattcccgggtttgttgatccttcttaccgtattgtgcttcaactttgtcggagacgggctgcgtgatgcgcttgatccgaaaaatgtgaaatgatctcccggacgaacgggagatttttttgttgcaatgcagtcggaaatccagctccgtaaaacggaaatctcatattgaaatggaataatttatctatcccttgcctatactgtggacaacagtttttataaagtgaggggtcgaatatgttatttcttcatgatgtatgggtcaattggtttgaaggggaagaaaacggctacaatgtatgccattttcacgaatggcggaaggaagacacggttgagcttttggatcagacgccgctgctcagagtgccgtcagtattatttcattacatagaaaacgacttatcagagcttccgaaagagctgcttgaccaagtccaccagaagtcatacgtgcgaaaaaatcatgagcggacaaagctggagtactgttttgtcgtgacagacgggatcggcatcattgccgtggatacgatcgggtataccattccggtcagaaagagccgcctgattccgagacaggagcagcttgtttatgaaatggtaaaggatgtagaaccggaatcgtttcaatttgagccgtcgcaattggagtcttcaaaggaatatcacattttgtcattggcgccggggcatgtcagaggtctgacgagaaaagagcggcagatcaagcagctgatgtttatggcgctcgaccagctgaaagggctgaaaaaccgtgcggaaattgtgtattggtacacggaatggaatccgcatatgtatgagcagatcaaacggatgagttttgaagagatctgggacatgctttacaatgaaacaattgaaggctggtcggataaacatcttgcgttctgtgaaaatttgattaaagggcagccgtttttcgaaaagctttgggaaatggaacaggaatcaaaagtgaactaaaaaaagaggcggggattctcccgcctcttttttttatcttcttttccgtccgagacccatggcgttttccattttcttcaccattttgccggccgttttgtttgcgcgcgccgccccttcgtcgagaatgcggtcaagctcgtcgctctcaattaattcacgatagcgctcttggatcggtgtcaatgcgccgataacgacttcggctaaatcgcttttgaattcaccgtaccctttgccttcatatttagcttctaattcttcaattgatgtgtttcctaaaatagaataaatcgtcaaaagattagaaacgcccggtttgttttctttatcatactttacaatgccttcagaatcagtcacggcactcttgattttcttctcgagctgcttcggctcatcaagcagcgtgatgaatgccttttggttcggatctgatttgctcatttttttgagcggatcagccagtgacatgatgcgcgcgcctgattcaggaattttcacctcaggaatcgtgaagatgtcattgtattttttattaaagcgttccgccaggttgcgggtcagttcaagatgctgtttttggtcttctccgaccggaacaagatccgttccgtacagtaaaatatcgccggccatcagcggcggataggttaacagtccggacacgacggcttctttgccctttgacttatccttaaattgagtcatccgctcaagctcgccgatatatgcgacgcattggagcatccaccccgcctgggcatgagcgggaacttccgactggataaagagggtcgctttctcgggatcaagtccgacggccagataaagagccgcgagattgcggatgttcttccgcagctcaagccgatcctgcggaactgtaatcgcatgctgatcgacaatacagaagtagccgttgtagtcatgctgcaaatcaacaaattgcttcattgcgccgatgtagttgccgagggtaacggaaccgctcggctgaatgcctgaaaaaatcgttttcttcatagttcttacctcatttcttaaaacataataaaaaaagcccattcttcccgtagaaaaaagggacgaatgaaccgtggtgccaccctgattattccattacaatggaatcgctcgagacgttggtaacggaggctgctccggctgggcctactaacgttcggtcagctgctcagaagtccattccacatcgcccgttacctgctcccagcaccgcagactctcttcaaacggatgaaaatgtgtactactcttcatcatcgcaatcacaacaaatgtatttgattgatctattataaatcaattatagccaaatgtcatcagaggaatacaagcttatttccagtttactttaggggtggaaatcctcaaaaagaactgaaaaagcttaaatgataacgtatatcaacatttcgtataacgaatattatatgtaaaaagcaatatgaactggaaattacattaaaaaaatttagttaggtcatgctttaaactatagaagtgtatcacctttttgacagaaaaactgaccaaatttaaatattttaaattgagaaaatagtattgcaataaattattcatttcattataatgaacttgttcactctattgttacagcttctttacataaaataatcagaaaagacggaacacaattaaagtttagaaaaatattaagttattttgtctgatatttctgagtatttagtagtaaaggctgaaaaatttgattagggggttagtgcatgaaaaagcgttggtctattgtaggtttgatgcttatcttctcgcttgtattaagtgcgtgcggcggattcagcggcggatcaggcggcggcaaaaaagacaccaaaggacagacttcacttaatatcaatattaaaaccgagccgttctcattgcatccgggtttagcgaatgattccgtttcaggaggcgtaatccgacagacttttgaaggattgacacgcgtaaactccaaaggtgaccctgaagaaggaatggcatctaaaattgaaacaagcaaagacggaaagacctatacatttacgattcgtgacggtgcgaaatggtctaacggcgaccctgtgacggcgcaggattttgaatatgcatggaaatgggtgcttgacccgaacaacgaatcacaatacgcttatcagctctactacatcaaaggcgctgaagctgccaatacaggaaaaggcaagattgatgatgtaggcgtaaaagccgtaaatgacaaaacattaaaggttgaactgaataacccgacaccttatttcacgcaattaacttcattctatacgtatatgccgatcaacaagaaaatcgccgaaaaacataaaaactggaacacaaacgcgggcgaaaattatgtgtcaaacggcccgttcaaaatgacggcctggaaacacagcggttccatcacgctcgaaaagaacgatcaatattgggataaagacgctgtgaaattgaagaaaatcaacatggtgatgattaacaataacaacaccgaactgaaaaaattccaggccggtgagcttgactgggcaggaatgccgctcggccagcttccgactgaatctctgccgacattgaaaaaagacggatctcttcacgttgaaccgatcgcaggcgtgtattggtacaaattcaacacagaagcgaaaccgctgaacaatgttaacatccgtaaagcccttgcttatgcgatcgaccgctcgtccatcgtgaaaaatgtaacgcagggcgaacaaatcccggccatggctgcggtgccgccgtcaatgaagggattcaaggataacacaaaaggttacttcaaagacaatgacgtcaaatcagctaaagaattcttaaataaaggactgaaggaattaggcgtcaagagtgcctctgaccttccggcgatcaagctgtcctacaatacggatgacgcgcatgcgaaaatcgcgcaggccgtacaggaaatgtggaaaaagaacttgggcgtcaaagttgaacttgataactccgaatggaatgtttacatcgacaagctgcacagccaaaactaccaaatcggacgtatgggctggctcggcgatttcaacgatccgatcaacttccttgaattgttccgtgataaagaaggcggaaacaatgataccgggtgggaagatcctgagtttaaaaagctgctgaaccaatctcagcttgaaacggatccggataaacgtatcgaagagctgaaaaaagcagaaaagatctttatcgacgcaatgccggtcgcgccagtttatttctatacggatccttgggtgcaggataaaaacctcaaaaatgtgatcttgacaggaacaggcgaagtttacttcagaaacgcttcttttgaataaaagccggttctgaaaacaaaagacccaaggtatatggggaggatgtccccatatacctttcttactgattacgtataaaattgtaaaaaacatggaggtgttcaccttgctgaaatatatcggtaaacgattcatttacatgatcatcacattgtttgtgattgtgaccgccacgttcttcttaatgcaggcagcgccgggcggaccattttccggcgaaagaaagctgccgcctgaaattgaggcaaacttaaacgaacactatggtttggacaagcctcttttcgttcaatatgtcagctacttaaaatctgtggcgatgtgggacttcgggccttcttttaaatataaaggccaaagtgttaatgatttaatcaattcaggcttccccgtctcattcactctcggtgcagaagctattctcctcgctttagcgttcggtgtgcttttcggggtgcttgctgccctgtaccataataaatggcaggattataccattgcgattttaacgatctttgggatctcagttccgagctttatattggcgacgattttgcaatatattttctcaattaaattagaactgttcccggtcgcaggatgggaatcctgggcatacacctttctgccctccattgcgctcgcttccatgccgatggcgttcattgccagactctcccgttcaagcatgattgaagtgttaaacagcgattacatacggactgcaaaagctaaaggactgtcccgtccgtcagtcaccgtgcgccatgcgctgcgaaacgcgcttttgccggtcgtgacatatatggggccgatggcggcatccattttaacgggaagtttcatcattgaatccattttcggaattcccggtttaggcgcgcattttgtaaacagcattacaaaccgtgattatacggtcattatgggagttaccgtgttcttcagcgtgctcctgcttctatgcgtattaattgtagacgtgctgtacggattaatcgatccgagaatcaagctttccaaagcaaagaaaggagcctagaccatgcagaacattcctaaaaatatgtttgaaccagcttcagctaatgccggcgatgccgaaaaaataaataaaaaaagcctttccctctggaaagacgccatgctccgcttccgcagcaataagcttgcgatggtcgggttcgtactgatcgttcttattattctgatggcgatttttgcgcctatcttttcaaggtatgattatgccactaccaatctattaaatgcggataaagcgccgtcgaaagatcattggttcggcacggatgaccttggaagggatatattcgtccggacatgggtgggcgcgcggatttccatctttatcggtgtcgcagctgccgtgcttgatttattgatcggcgtaatctggggcagcatttccggattccgcggcggacgcacagatgaagtgatgatgcgcatcgccgacattctgtgggctgttccttcattattaatggttattttgctgatggttgtcctgccgaaaggattgctcaccattatcgtcgccatgacgatcacgggctggatcaatatggcgaggatcgtccgcggacaggtgctgcaattaaagaatcaggagtatgtgcttgcttcacagacactcggtgccaaaaccggccggcttttgtttaagcatatcgtcccgaacgcgatgggctctatactcgtaacgatgacactgacggttccgacggcgatttttacagaagcgtttttaagttatttgggcctcggcgtacctgcgccgcttgcgagctggggaacgatggcctcagacggattgcctgcattaacctattacccttggcgtctgttcttccctgccggctttatctgcctggcgatgttcggctttaacgttgtcggcgacgggttaagagacgcgctggatcctaagttacgcaaataaggagtgatatgagtgacacgtttgctagaagtaaaagacttagccatttcatttaaaacatacggcggagaggtacaggcaatccgcggcgtcaatttccatttgaataaaggagagacgctggcgatcgtgggggagtcgggttccggaaaaagtgtgacctcccaagcgattatgaagctgattccgatgccgccgggctactttaaaagaggacagattctttttgacggacgcgatatcgtgccgatgtccgaaaaagaaatgcaggccatcagaggaaaggacatcggaatgattttccaagatccgatgacctctctgaacccgacgatgagagtcggcaagcaaattacggaagtgcttttcaaacatgaaaaaatctcaagtgaagcggcgaaaaagcgcgccatagagctgcttgatctcgtcggaattccgatgcccgaaaaacggatcggccaattcccccatgaattttcaggcggtatgagacagcgtgtcgtcatcgcgatggcgcttgcggcaaatccgaaactgttaattgccgatgaaccgacaacagcgcttgatgtgacgattcaggcacagatccttgagctgatgaaagatctgcaaaagaaaattgatacgtctatcatttttatcacgcatgatctcggcgttgtcgccaatgtcgccgaccgggtcgccgtcatgtacgcgggtcaggtcgtcgaatcgggcacggtggatgaaatcttttatgatccgcgccatccgtatacgtgggggctgcttgcctcaatgccgagtctggacagcaccgatcaggaaaaactgacggccatcccgggtacgccgcctgatctgacgaatcctccgaaaggggatgcatttgcgctccgcagctcatatgcgatgaaaattgactttgaacaggaaccgccgatgtataaagtgtctgatacgcattttgtgaaatcgtggcttctgcatcctgatgcgcctaaggtcgagccgcctgaagcggtgaaggctaaaatccgtcagcttccgaatacgtatcagcatcctgttttaatgaaggaaggtgaaaaaaatgactgagaaacttctcgaaatcaaacacttaaaacagcattttttcacgcagaaaggaacggtaaaagccgtagatgatttgtcatttgatatttataaaggcgaaacgctcggccttgtcggagaatcgggctgcggtaaatcaacgacgggccgcagtattatccggctgtatgaggcaaccggcggggaagttctctttaacggggaaaatgtccacgggaaaaaatcccgcaagaagctgctggagtttaaccggaaaatgcagatgattttccaggatccgtacgcatctttaaatccgagaatgacagtcgccgacattattgccgagggaatagatattcaccgcctggcaaaaacgaaaaaagagcggatgcagcgggttcacgaactgctggaaacggtcggtttaaataaagagcacgccaaccgctacccgcatgaattttcaggcggacagcgccagcgtatcggaatcgccagagcgctggcggttgatccggagtttatcatcgcggacgaaccgatttcggcgcttgatgtctccattcaggcgcaagtcgtcaatttaatgaaagaattgcagaaagaaaaagggcttacttacctgtttatcgcccatgatttatcaatggtcaaatacatcagcgaccgcatcggcgtcatgtatttcggaaaattggtggagcttgcgccggcggatgagctttacgaaaacccgcttcacccatatacgaaatcattgctgtccgctatcccgcttcctgatccggactatgaaagaaatcgcacgcgaaagaaatacgatccggcagttcatcagctccaagaaggagaaaaaatggaattcagagaagtgaaaccgggacattttgtcatgtgcacagaagctgaatttaaaacctatctataaacgtatcatcctccaagactgagtcttggaggatttttttgcgcacattcaagtttattaagcctgctcccgtttttctataatggaaaaaaagggggagatcagtatgaaaaccattttgtgcgccatttgtgcgggactgtttatcagtgcagccgcttatccggcccatgccgctgtgaaagaggagcagccgcttgtaaaagtagcactggctgaaaaagaattgccgaaatcaaatgcacggttcgcttatccgtcagggctgcatttttcacatcctgataaggtgcggggcatttacgtcacaggacattcagcgggaggaagcaaattcggggagctgacagactttgtggacaaaacggagctcaatacaatggtgattgatgtcaaggacgacaacgggaacctcacctttaagccggacggccattctgagtatgccaaaatcgccaagccgtacatcaaagacccaaaaaagatgatgaaaaagctggaggaaaaaaagatctatccgatcgcgcgtattgtcgtatttaaagacagcgaactcgcgaataaaaagcccgagtggtcctttaaagaaaaaaacggaagtgtctggaaaaacggccgcggcgaatcgttcgtcaatccgtttatgaaagaagtatgggattacaatgtaaagattgcaaaacaagccgtaaagatgggttttcaagaaattcagtttgattatgtccgttttcctgaagggtttgaaaaacgtgatgacgaactgacatacggacacggcgattacggaaaaacagcagacagcaatgtgcaaaaacgcgttcacgccgtcaccgattttgtcggttatgcgaagaaaaaactcaagccgtacggcgcggatgtgtcggttgatattttcggctattcagccacgctgccggaagcgcctggtatcggccagaatttcagcaaaatttcagaccaggtcgatgtcatttcatccatgatttatccgagccattggacaagctatttcggcattgataaaccggatcttgagccctacaatgtcgtcaaagaatacgcgaaggtggaaaataaaaagctgtccaagctgaaacacccgcctgtatcgcgtccgtggcttcaggacttcacggcatcatatctcggcagcggaaattatcaaaagtacgggaaacgccaggtggaggaccaggttaaagcgctgcatgatgaaggaattgacgaatttttattgtgggacgcggcaaaccgttataccaaaaacgtcgattacacaccattttaaaaaaattgaaaccatgttaaaggatcacacgtcttaatagatgtaagattgtttaaacaatcggaaatggggtatatctaaaagtgtgaagacaacgaacccataaggagcaaatgaatgaactggtacgaaaagctgagtgaatattttccgattgaagaaatgaaatcaaaagcgcatatggaagctctgttaaaggagcaaagcgatgtttatcataaagaagaggggcagtaccacgtgctgatgtatgcggaatttgactctttcatctttattgattacctgtttgtgtcaaagaaatccagaggacaaggcctcggaagcaagctgatcggcagactgaaaaagaagaacaagccgattctgcttgaggtggagcctgttgacgaggatgacacggatacacagaaacgcttgcgtttttatcaaagagagcatttcaagcacgcgcagtcaatcgggtatcggcgccggtcattggctacgaatgaagtgaacaaaatggagattctgtactggtcacctaagacggaatcagaagaagaaatatttgaagcgatgaaacagacatatgaaaacattcacacttataaagatgaaaaatggtacggagaatcatacgagaaaacggatgaagttctcaaagtcattgatgagaaaaaacaaaaaaacattttcgatcagctgagctaattgagaatggggaaaaatcctccagccgtaaatttgccggattgacacatttttttctcaggagactgttcacacttacttttttatagtataatacctataaagattccttttttaaagtcatttcaatttgagaatacaaacatgttcatcctactaattagaggagtgaagattaatggttacattatacacatcacctagctgtacgtcatgcagaaaagcaagagcttggcttgaagagcacgagattccgtttgtagaaagaaacattttctccgagccgttatcaattgatgagatcaagcagattctgcgtatgactgaagacggtacggatgaaattatctctacccgttctaaagtattccagaaactgaacgtaaatgttgaatctatgccgcttcaagacttatatactttgatcaatgagcatccgggactgctccgccgtccgatcatcattgatgaaaaacgtctgcaagtcggctataacgaagatgaaatcagacgattcctgccaagaaaagtgcgttctttccaattaagagaagcacagcgtcttgccaactgatataagcttacgataagcatggaaaaagcccaaaaccatcgcggtttgggctttttgttatttttcagtctgctggtaaatcatactggcgaggataacaaaaacaacggtcaaaatcggcagcatcatctgtatcatgccgtgttctgccatgaaaaatgacagcttgctgtctccggcaatcatttcaccgccggtaaatgcgagaagaccgctcccggcatacatcaataaaggcattttttccatggcggcatgaacgagcttgctgccccaaataataatcggcaccgagatgaagagaccgatcactactagtgtcagctcaccgtgagaagcgccggctactgcgatgacattgtcaagcgacataaagatatcagccagaacgattgtgcggatggctttccaaagagaagaactgcttttcacatgctgcgcatctttcttctcaatcagaagctgatagccgagatacaataaaaataccccgcctgcgcattgtaaaaaaggaacattcaataaatagaccgcagcgctcgtcagaacgattctcaagacgactgcgataaatgttccgaagatgatcgcttgctgtctttgtttatgggccagattccggctggccatcgcgatgacgacggcattgtcaccgccgagaataaggtcaatcccgataataagcagaagggacagcaggtaatcgtgcggcatggtaacacctcgcttatagatcgattgcttgtacagctaatatatgaagcagtgcgctatttatgatgggaaccgggagaaagcctgtttttcggtgtgaaaatgcttttttatttcttttataactgttttatcataaaatagaaatataaagaatttgcgctgtcttctataaggttaagatgtggacggaatgggtaaagtgtagtaaagtactattcatcgggagcttagatgtcccttcaacatcttataaagaagggaaggttggcaaaatggaaatagaaagaattaatgagcatactgtaaaattttatatgtcttatggtgatattgaagatcgcggttttgacagagaagaaatctggtacaatcgcgagcgcagtgaagaactgttctgggaagtcatggatgaagtgcatgatgaagaggaattcgctgtcgagggtcctctttggattcaggttcaggcattggacaaaggactggaaataatcgtaacaaaagcccagctttccaaggacggacaaaaactcgaactgccgatcccggaagataaaaaacaagagccggcagatgaaaatctcgatgctttacttgatgatttccagaaagaagagcaggccgagagccgggaagataaggagcaaaagcttcagttcactttgcggttcgatgattttgaggatctcatctcgctatcaaaattgaatcttaacggaatcaaaacgaccctgtattcgtttgaagaccgatattatttatatgcagatttttatgagcaaactgatgaagaggttgaaaatcagctaagcatcctgttggagtacgcgcacgaatcatcagtcagcattcaccgtcttgaagaatacggcaaattagtgatcgctgatcatgcgttatatacaataaaaaaacactttgcatcataaaaaaccgatttctctcagcagaaatcggttttttttgttctgaatgacaggatgaacggctgaaaaccgtataacggctctcatccgcaaacaggattatgccttcttcctgctgaatacaacaagattcaggaaaggagaagatgcaacatgttcagtgcagtgactgccggcggacggctcattcagctggccggaagctattcaaaggaaaaagcggcggagctgagaaagaaacgctggttctgccccgtttgcaaaagtgagcttgatatcaaactgggacgcgaaaaactgccgcacttcgctcataaaaaaagcaggctgtgtcccggggaatccgaacctgaaagcgaataccatctggaaggaaaaagacagctttttctctggctgaagacacaagggtgcagtgtcagcctggaaccgtatctgacttccgctggacagcggcctgacttgacggcagaaagcggagaagaaaggctggcttttgaatttcaatgtgcgaacctttcggcggactctttaaagagccggacggcaggcctgaaaaacgccgggtaccggccggtctggatcattggggcaaaacggttaaaacggatgaccgcgcaatttttccggctttctgcttttcactggcagttctttgaagtcaattcattttcctccttaatgttttactgccccgacgcccgctccttttacaggctgcattccatcactccgttttacaccggctattcttatgccggcttaaccgcaatccctcttcacaaagcaaatctgaaagacatttgtcatccggaagggcggcgcagcgtcagactttcctcgtgggggcgtgccgttaccggcttccgcaacaaaggcgggcggtttttatctgaagatgccggtcttatccggcgtcttttttacgaaagacatcaggttgcatttccatttctcccctctgaagtgtttattcccgtttcagcaggctttgtgtttgcaagtcccgtttttgtgtggcagggccatttatacttgcggcttgcggaactttctaaaaaaggcgcgccgatccgattatccggcatggttcatgatttacggcaaaaaatcaggcataaggagatccggatgcggtatggttcacaagacagccttatcggaatggcggtaaaacaatatgctgatttcttatgcttgcaggattttttaagggaaattgagaatgaagtatatatgccctcatctcaacagaagcgccctcaaacggcagaagagctgcgccggcgggacctgctcttttttggggaatgagaatgcttcatttcgttcaccctaacgtcaaggtggtggcgaatgtgaggggcgtacaagcattttgttttcgttttttcactgtattattggtatgctcggtcttatatgccgcatatgatttgacaaaaggcagtgaaaagccggaagataatcacaacacaagtttttggagaaacaatcgttttttcaattggcttgaagtaaagaaaacgagggggatcaccatgactgaggaaaataaagcagcacagctgcctgagagaagtgaagtaaaggcagagcatacatggagactagaggatatttttcctagtgatgaggcctggaataaagaatttcaagcagttaaagaattaattccgaatttatcttcatttaaaggcacgcttgctcattcggctgataatttatacgcggcgcttacggcacaggatgaagtgacgaaccgccttgggaaactttatgcatacgcacatatgcgctcagaccaggatacgggaaattctttctaccaagggctgaacgacaaagccgcaagcctgtattctcaggctgccagcgcgactgcttacattgaaccggaaattctggcgattcaggaggacaagctgcaccagtttattcttgaaaaagaggagcttaagctttactcccatgcaattgaagaaattacaaaacagcgtccgcacgtgctgagcgaacaagaagaggccctgcttgcggaagcctctgaagcgctgtcttcgccttccaatacattcagtgttttaaataacgccgatattacgtttccgtcgattaaagatgaaaacggcaaggaaactcaaatcacacacggcaactttattaatttcctggaaagcagcaatcgtgaagtccgcaaaaacgcatttgaagccgtatataaaacatacggacagtataaaaacacgatggcgactacactcagcggcactgtaaaaaaagataatttttacgcccgtgtgaaaaagtataaatcagcacgggaagcggctttatccaataacagcattcctgaagaggtttacgataaccttatcaaaacgatcaataaacatcttccgttattacaccgttacattgacctgcggaaaaaggtgctcggccttgatgaagtccatatttatgacctgtacacaccgcttgtaaaagattcgggaatgaaggtaacatatgaggaagcgaaagattatatgctcaaaggacttgctccgctgggcgaggaatacgcgtctattttaaaagaaggacttgaaaaccgctgggtcgatgtatacgaaaacaaaggaaaacgcagcggtgcttattcgtccggtacatacggcacgaatccgtacatcttgatgaactggcatgataatgtcaataatctgtttacgctcgttcacgagttcggccattccgtgcacagctactatacgagaaaatatcagccgtatccgtacggtaactacagcatttttgtcgctgaagtcgcttcaacgactaatgaagcgctgctcggtgaatatatgctgaacagcttaaaggatgaaaaacagcgtctgtacctgctcaaccacatgcttgaaggattcagaggcacagtgttcagacagacgatgttcgctgaatttgagcatctgattcatacgaaagcgcaggaaggcgagccgctaacgcctgaactgctgaacgaactttattatgatctgaataaaaagtatttcggtgacaacatggtgattgataaagaaatcagtctggaatggtcaagaattccgcatttctattacaattattatgtgtatcaatatgcgacaggctacagtgcggcccaagcgctgagcagccagatcttaaaagaaggcaagcctgcggtggagcgctataccgaattcttaaaagcgggaagctcggaatatccgatcgacatactgaaaaaagcgggagtcgatatgacatcgcctgaaccgatcgaggcggcctgcaaaatgtttgaagagaaactgaacgaaatggaagagcttctttcgaaagtgaacccttcgtaattcaaaaaagcctgtgcattaaatgcgcaggctttttctaaaaccccttaaacgtttttcggtgattcagccggtacagggcaaacaatatggacagaaacagcagtggagatgtaatgtaaatcggcagcatgtgcatcatggccagcaggtttaaaaagaagaaaaacacaatcattccgatgatcaatacggtgcggagcattgatttccctccttgtttatgattgatatattctatgaaaacaagcagtcagttatgttttgtgacaaaaatatgaacattaatcttatggcttgtcaaaactcgacaagatttgatatgataaggatgtgaaattgatcacaaacaaacattacccctttgtttgaccgtgaaaaatttctcccatcccctttgttgtcgttaagacatatgaaaccgcgcttatcccggcgcggtttctttatttgcacaaaaaaagccggctccgtaaggaatcagctttttttaatggtcacaacaggtgacatcctcctgggttccggccagagatttccaaaacagaccgtgctttgcttccactctggcgacctttttggcgaatgccagttttttcatttctttttcaacttcttctagactcaaatcataaacgagtgcgatttctttcgatgcgacaaaccggaaatattcaatgaaacattccaaaggcggcgtttcagaaggcttcggttcatccccgagcatttcgaataagatctcttcgtatacgtcataagaatagttgccgggaaccttcagcccttcatcatcatgcaggctgttaaagaacgtcaatgtcgggttgacggtgacgtccatttccgccgcgattttcatatcgcactgaagcgcttttaccgcgctttgcgaatggaggtcgcgcttgaattcttcaacatccaatttcgtcttttcagcaatttctaaaagaacgtcttcatccgtaatattctgcttggagacaaacaggctttcctgcatgctgcggagaaacagaatgcccgcttttcttccctgcagttcggccgcttttaaagcgagtgcggcaaggtagggcgatgcaagaggctgatcctgctcaagccaaaggcttccgtcacagggcatcccggaacggttcgcaattttttcccaagcttcggcaagaaggtgttttttccgcttttgcttattcagcgatgtaatgctcgcggaaacaatgatccgcagggtgaaaaaacgtccgtatttgatttttaatttttttatggcgggctccagcgaccagcattcaggacataaagggtcgacaaacatgtaaatttcgagcggtttttttggatgtccgtggcaatgggcgaagtattgctcatgctgataattcgtcaatatgatcgatcctccgcttctgactggtttaccatatgcctggccgtcagttccagacgcccgtacagaaattcacgaatatcgccctccagcccgacctgatccatcgctttgctcatacagcttagccacgcatcagccctctcatccgtaatcggaaaggggagatgccttgccctgagcatgggatgtccgtgctcttcagtataaagaggaggtccgcccaaatactgggttaaaaattgcttttgttttctggccgtttcagtcaaatcacttggaaatatcggcttcagcaagggatgagacgagacacgctcataaaaagtatcaacaagttgcgatagaagttcctctccaatcgcttcatatggtgcgttaaacgattgtcccatgttgactactcctttatatggctaataggaatcataattcccattgcgaatttatctttcagttttactatcttcagttactgtatattttagcaataacattttatttctacaaacaaagtgcctttctgtcaggcgcttgtatttcatatcatatcacatcgccttcattcatgtgtaagatttcactccgcaaaaaaaccagagggcgaaggaagcctctctggtttacgcgtaatactgccgggttatgtttttgacatattgctgtgtttccttaaacggcgggatgcctccgtaccgatctacgttgccggggcctgcgttgtaggcggctaacgcgagagatacatttccgtcgtatttcgtgagcatctgctttaagtactttgtgccgccctcagcgttctggacgggatcaagcgggtttgacaccccgagtgattctgccgtggaaggcatgagctgcatcagccccattgcccccgcaccgctgaccgctttcggattaaagcctgattcctgtttaataaccgcgcggatcagtttttcgtccactccgtatttttcggctgctttctgaatggcgctgtctattgaaaagtttccggtgctgatgtcagaagccgcattcggagactttatgctcggggaaacggtctgtgaagctgccgcggaaccggatgaaaccggaattctcggtgaatatgaagcgtgagcggtccgcacaccgtttaaaatccctgattccggctgctgccggacggctgtgtccgtatactggctgagcagcgcgctgaaattggcaagcgggctttctgaagattgtccgcctgaatccgtgcttgtatgagagattgattgcagcgccattgactgcagctggagaagggccgcccaattcgttatattcactgtgtcattccacctttttttgtttctgttcataaaaacgctggattttatttttcgtgatccgctctgggatgccgaattgcttgagcaattgttcaaacgcctgttttccttcatcccagtcagcagcctcgaattccaattcaaagtcttctttctctaaatatcggctgtgatctaaaatgattaagcctttttctgattctttttccgcgcgtgcggtcgacagcgttccgaagcagcaaatgtgttctgaacggattccgagaccgtccagctgccgtttgacggggccatccggaatcttgaagacgtcaagatccggtgccgccgcaagctgttggtgcgtttccagcagaccgaccgcggcaggttcttttaaagtcagaacgaacgagccgtctttttctcggatgcggagtgctgattttttttgtttcagggaaaaatctttcgtgtcgaaataatgattgacctgctgtttaaaatcatattctttcatgcagagtgcttcactcagcttcagaaattctgattttgtcagcaggtttttgaattcaatttctatttcttgggtcatgacagtcttcctttcaggacgaaaaattgtataattcccattatctctttagaggttacgtttatcaatatcgaccttgatatgataaaataaatgctgtactttgttaaaaaaggagaacattatgcaaaagagaattgaaatccagaatgcatcattaacagaagacgcgctccgcttgaagtgcggagaagacttaagcggagcggaacgcaaagcctcaggtcaaatgcttgttgattccgatcactttgcttttgtatacatacttgaatcagctgactcttttgaatatgtcattataaaagaacatgtctggccggatctgaaagaagccttagaccaaggaaaaccggcggtccttgaggccggcgcgaaaacggttgaactttcagggctgcatgaagaactcgattatcttcttgaaaatattaaagataatgcaaactacggagatatggaagaaaaagtgaaaaacgtatttctttagaacaggttcggaattgggggatgtacgatggatgacaaacaatgggagcaatttctagcgccataccgccaggctgttgaagaattaaaggtgaagctgaaaggcgtcagaaccctttatgagtatgaagatgaccactcaccgattgagtttgtgacaggccgcgtgaagccggtggcgagcatacttgaaaaagcgagacgaaaaagcataccgcttcatcagattgaaacgatgcaggatatcgcggggctgcgtattatgtgccaatttgtcgatgatatccagatcgtcaaaaatatgctgtttgccagaaaagattttaccgttgtcgataagcgggattacatagcagagcataaggaaagcggatatcggtcttaccaccttgtcgttttatatcctttacaaacaacgtccggtgaaaagcacgttcttgtggagatacagattcggacgcttgccatgaacttttgggcaaccattgagcattcactgaattacaaatacagcgggaacattcccgaaaaagtaaagctgaggctgcagcgggcctcagaagccgcatcccggctcgatgaagaaatgtcagaaatccgcggagaaatccaggaagcccaagccgcgttctcgcgaaagaaaaaagcgggagaccgccagtaggaaggaaaggaggggaatggcatgaaatttgccgtttcttcaaaaggagacgaggtttcagatacactgaaaagcaaaatacaggcgtatttactcgattttgatatgaccttggatgaaaaagagccggaaatcgttatttccgtcggcggtgacggaacgcttctttacgcatttcacaggtacagcgaccgtcttgataaaacggcttttgtcggagttcacacggggcatttgggtttttatgccgattgggttccgcaggagatagaaaagctcgttctggccattgccaaaacgccgtatcataccgtggagtatccccttcttgaggtgattgtcacttatcatgatgaagagcgtgaggagcggtatctggctttgaacgaatgtacgatcaaaagcatagaaggcagtctcgtcgctgacgtggaaattaaaggccagctgtttgaaacgttcaggggagacggtttatgtctgtccacgccttccggaagcacggcttataataaggcgttaggcggtgcaatcatccacccttccatcagggcgattcagcttgccgaaatggcatctatcaacaacagagtgttcaggactgtcggctcgccgcttttgcttcccgatcatcataactgtgtcatcaaaccgagaaacgacgtcgactttcaagtcacaattgatcatttaaccttgctgcataaggatgtcaagtccattctatgccgtgtggcaaatgaaaaagtcagatttgcaagattccgcccttttccgttttggaaaagggtgcaggattcctttatcggaaaaggcgaatagaaagaggaaacggattggacaacttttttatccaaaagaacatgactgcccgggatgccggcatgacggttaaagaatatacggcgcagctcggcatttcaaagcggcttctcgctgacattaaattcggcgggggagacctgcttgtgaacggagagcatgtaaccgtccgcaccgtgttagcggagggagacgtgcttaagattgaatttccgaaggagcatgtgagtgaaacgcttttgcctgagccggttccgcttgatattctttatgaagatgaccatgtgcttgtggtcaataaacagccgtatgtctcctcaattccatcaagagaacacccgtcaaaaagcatcgctaacggagtgatcagccactaccgaaaaagcggcgtgcaatcaacggttcatcttgtcacccgccttgacagggacacatcgggggcgatgctcatcgccaaacatcggctttcccattctcttttgtcggcagcacagaaaaaggggcttgtcagcaggcgatatctcgctgtcgtacacgggatcatgctgcagaaggaaggaacggtggacgcgcccatcggaagaaaacacgacagtattattgagcggatggtaacgccggatggacaacgagcggtgacgcattttcaaacggaaaaagcgggacatgcgtttacgcttgcagccctgcggctggaaacggggcggacgcatcaaatccgggtgcacatgagctacctcggccatccgttagtcggtgatacattgtacggcggaaaaaatgagggaattgcccggcaggctcttcacagtgagcggctttcattcgtacaccccatgaccggagaaacgctcgtttttcacgctccggtgcctgacgatatgaaaacattaattgaacacatgtaaagcccgaaccgtttgccggtttcgggctttatttcatgcctgcctgccgtgatcctcgcgaaatcgtgaagcatcatacggcatagagctttccacagagacggtttcatgctcgggaaaacgaaagcctgtcagctgattgccgaagacacagcctgtatcaatgttgaccgtacggttgacgatccgggggcgttttaccggggtatggccgtacacaacccacgccttgccttcatagtcggcagcccagtctcttctgacgggtctgccgtcgggatgcgtttcacccgtaatatcgccgtacagaacaaattcttttaccttacgcgagtatttaccgatatcgtcagcttttatgccggcgtgggcgacaacgagatcgccattatgtaaaatgtcataaagcggcgctgactcatataatcggataaattgtccggagacttccgttctgtcggcgggagacagctctttcagttcggctgccgtcgtttccagtccgtgcatcacttttacagggtttccttttaagtaacgatacagtttgttgcaatgatttcccgggacataacggacggctcctttttcatatgcttttgccacaaaacgcatcacttctacggattttgggcctctgtccgttaaatcccctgcaaagacaagcgtcctgccttcagaatggacgggcgttccgtctttcacttcatatccgagcttttgcattaaggcgatcatttcgtcataacatccgtgtatatcgctgatgatgtcataagccattcgtgtcagcctccttattaacggttttttatttattatggggctaattcctatacctaattacgctgttttggtacaaattaaaaaaagaattgaagaaataaagccttatcacttttttttcgcgttaagccttgttagaatatgcgttatgtttttaaaaaaagtaaggtttcgtccgcttaaagcgggcttttataacccttgttttaaggaggtatttacaaatggaacacacatcagtcgcatctttagtcgtcgttctgatcgtcgcttttttgacgccgctccttttacatcggtttaagctcagcatccccgtcgtcgtcgcggagatcatcatggggcttattatcggaaaaagcggcctgaatcttgtcgttcagggagacacgtggctggagacgctgtctgttctcggctttatctttttaatgtttttaagcggcttggaaattgatttttcttcatttgagaaagggaagaaaaaacaattccttccgaacggcaaggaagcgcccaacacgttttctgccgcgctgattatctttttcggcatctttattttatcattgctgctgtcctatgcctttgtattagccggttttattcaaaacgcatttttaatgacgcttattatttcaacaatatcactcggtgtggtggtcccgactttaaaggaagaacggatcatgaactccaatatcggccagatcatcctgcttgtcgccgttatcgcagacttggctacaatgattctgctcgctttcttctcttctctttacggagaagacagcggaaatatgtggcttctgttgattctctttgccgcgggggtcgtgctgtatttcttcggcaggatctttaaacaccgttcatttgtgcagtcgatgtctaaaggcactgtgcagatcggcacgagagccattttcacactgattatcgtgcttgtcgctttatcggaatctctcggggcggaaaatattctcggcgcgtttttggcaggcgttctggtatcgcttctgtctccgaataaagaaatggtggaacagctggattccttcggctacgggtttttaattccgatctttttcgtcatggtcggggtgaaattggatatttggacgcttttccaagatccgaaaacattaacgatgattccgctgcttctgcttgcgctgtttatcagcaaaatgttcccggtgttttatttaaagaaatggtacgacaaaagaaccgtgtttgcttcgggctttttgctgacgtccacgctgtcgcttgttatcgcggcggctacgatcggagaaaggctccacattatcagcgccaatatgtccggcgcgctgactttagttgcggttattgccagcatcatcacgccgatcggctttaagaaattattcaaacggcaaagcgcgccgcaggaaaaaaagcgcattacatttatcggcgccaaccaaatgacgctcccggttacgctggaattgcctgaggaggaatatgaagtacgggtcgtccatgtgtatcaggaaaatgccggggaaacgcttgcggaatccgttttttcggttgacacgatttctgattacgagcccggcacgcttgagtcgcacggtattttcaaaacggatattcttgtcgtggcgacgggaaatgaagatgtgaacgctgaaatcgccttactagcgaaagagaaagggactgagcgtatcatcgcaagcgtcggctcggttgagcatgaaacaaaactgaaagaagagggcatcagtattttttctatccttctgtctacaaaaacgctgctgcgcgcgttaattgaggcgccgggcgtgatgagcctcctgacgaatgaggagtcttcgttatatcagatcaatctggaaaacccggcgtataacggcatcattctgcgggaatttccgctgatgggcgatgtgattttcgtccggattttcagaggtgtggacagcatcgttccgcacggagacacacggctgaaaacaggagaccgtctcatcgtcacaggctcgcgcaactacgtgtcagaactgagaaaaatccttgaagcttgaccaaattgcaattcgtgataatatagaaggcataacaaataaatcattaatcgtatgaccactaggggtgtccttcataagggctgagataaaagtgagacttttagaccctcataacttgaacaggttcagacctgcgtagggaagtggagcggtatttttttggggttccttttatccatttaaattccaaaccacttttccgatgcgggaaagtggtttttttattttatcagggggaagacatgatgacattttctgaagaatgcagacaggcggctgccgaatggtgggacggaagttttgttcatccgtttgtaacgggaatcggtgacggaagcctgccgatagaccgtttcagctattacgtgctgcaagattcctactatttgacgcattttgcaaaagttcaggcgttcggcgccgcatatgccgaagacttgtttacgacgggcaggatggcgggccacgctcaagggacatatgaagcggaaatggcgctgcaccgcgagtttacggagcttttaggaattacggaagaagagcgtgcagcatttaaaccggcaccgaccgcctattcttatacgtctcatatgtacaggtcggtgatgagcggcaattttggagaaatattagctgcgcttctgccttgttattggctttattatgaagtcggcgaacacctaaaagagtgcaaaccggagcatccgatttatgaaaaatggatcggtacatacggcggagactggttcagacagcaggtcgaagaacagatcagccgttttgacgagattgctgaaaacagcacagaggaaatccgcgcgaaaatgaaagagaattttgtgatttcaagctattatgaatatcaattttggggaatggcttatcaaaaagaaggctggtccgagaaggacggaaaagaggtggaatcctttggagctgcacgcggtaactgataatcgcaaacccgttgccgagctggccgaggatattctatcgattcagcgcgaagtaagctttatccatatccgtgagcgggataaaacagcgggagagatcatgcagcttttgtcccttttgaaaaagggcggtgcggataaggacaaattgatcatcaatgacagggcggatatcgcgctttttgccaacatacaccgtgttcagcttccgtcccgcagcttttccgtaaagcaggtgcgaagcagatttccccatcttcatatcggacgttcggttcattcgctggaagaagccatccaagctgaaaaggaagatgcggattatgtggtgttcggccatatatttgaaaccgaatgtaaacaaggacttgaagcaagaggcatcagcctgctttcagagatcaaacgcacgctttccatccccgttatcgcaatcggcggaatgacactgcagacgatcggacacacaaagcaggcgaagccggacggaattgccgtcatgtcaggcattttctcagctgaaaatcccgaggaggcggcaaaacggtatgcacgtgcggtaagggaggccgattatgaagcagcactatgatacggcggtgatcggcggcggaattatcgggtgtgccatttcttatgagctggcgaagacgcagcagaacgttgtcttgtttgaagccggagaagtcggccgaaaaacgacaagcgctgccgcgggaatgctgggtgctcatgcggaatgtgaaaaccgggatgcgttttttaattttgccatgcacagtcaaaggctgtatgaagcggcggggcaagagcttgaggaagctagcggcattgacatcaggcgccataacggcggaatgcttaaactggcgtataccgaagaagatatcgcccgtttacggaagatggatgatctgccttccgtcacttggctttcagcggaagatgcccttgaaaaagagccttacgcttcaaaagacattctcggcgcaagtcttataaaagacgatgtccatgtcgaaccgtactatgtttgcaaagcgtatgcaaaaggagcgcggcgctatggcgctgacatatatgagcacacacaagtcacttccgtaaaacgggtgaacggagaatattgcatcacaacgtccggcggggatgtttatgctgacaaagtcgcagttgcaagcggtgtatggagcggccggtttttcagccggctcggcttgggacagcctttttttcctgtgaaaggagaatgcctttccgtgtggaatgacgataccccgctgaccaaaaccctttaccatgatcattgttatgtcgtcccgagaaaaagcggccggcttgtcatcggcgccacgatgaaacagggcgactggagcgatacgcctgacatcggaggaattgaggccgtcattgcaaaagcgaaaaccatgcttcccgccatcgaacatatgaaaatagaccggttttgggcggggctcaggccgggaacaagagacggcaagccgtttatcgggcaacaccctgaagacagcggcatcatcttcgccgccggccattttcggaacggcatcctgttggcgccggcaacggctgaaatggtgcgggatatgatcatggaaagacagattaaacaggaatgggaagaagcgtttcgaatcgatcgcaaggaggctgttcatatatgatccttcagctgaacggaaaacaaattgattggaatcgaaaagaggggacggttcaggatttgcttgaatcgtaccagcttgaccaaagaatcgtagttgtggagagaaataaagaaatcattgaaaaaaagaattatgaaaatacaagtttgtgtgaccgcgatgtcatagaaattgtccattttgtaggaggcggatgaggatgttaacaataggcggaaaacagtttcggtcaagattgctgttaggaacgggaaaatatccgagttttgagattcagaaagaggcggtggccgtctcggaatcagatattttaacctttgcggtgcggcggatgaacatctttgaagagtctcagcctaactttctcgaacagcttgatttgtctaaatacacgcttctgccgaatacggccggcgccgcaacggctgaagaggcggtccgaatcgcaaggcttgccaaagcttcagggctttgtgacatgataaaagtagaagtcatcggatgcagccggtcacttttgcctgatccggttgaaacgctgaaagcatcagaacagctgctcgaagagggatttatcgtgcttccgtatacgtcggatgatgtcgtgctcgcaagacgtcttgaggagctcggggtgcatgccattatgccgggcgcttcgccgatcggttccggtcagggaattttaaatccgctgaatctttcttttatcattgaacaggcgaaggtgccggtcattgtcgatgccggcgtcggatcttcaaaagacgccgcctacgcgatggagctcggggctgacggcgtgctgttaaataccgctgtgtcaggcgcagatgatccggtcaaaatggccagggcgatgaagcttgccgtagaagcgggccgtctttcttatgaagccgggagaattccggtgaaagattacggaactgcaagcagtccgcgagacggtcttccggtatgacggacagatattccagacaggagctgtttcagccgatcggtcccaccggccaagagaagctccggtcgtctcatgccgtgattatcggcgcgggtgcgcttgggacggcaagtgcggagatgcttgtcagagcaggggtcgggaaggtaacgatcgctgacagagattatgtggagtggagtaatctccagcgccagcagctttataccgaagacgatgtcagacaggaaatgccgaaagccgcggcggctgaaaaacggcttcggtctataaatagcgatgtagaggtcgagggatttgtcatggatgtcactgcggaaaacgcacccggattgattcgtgatgcctccctcatcgtggatgccgccgacaactttgaaacgaggctgattgtgaatgatgcggctgtgcagaaaggaattccctttctgtacggcgcctgtgtcggcagctacgggctctcttttaccgtcattcccggtgtcacgccgtgccttcactgtctgcttgagacattgcctttaggcggtatgacatgcgatacggcgggaatcatcagcccggctgtattgcagacggccgtttttcaggcagcagatgcgctgaagctgttaacgggcggatctatcgagcatgttctccgttcctttgatttatggaaaaatgaacggtcagaaataaacgtcgcccgtcttaagtcggctgattgcccaagctgcggcacaaacgattttccgtttttatcctatgaaaatcagacaaaagcggcggttctgtgcgggcggaacacggtgcagatcagaacggggatttccgaacagtttgatctgcaaaatcttgcgggacagctcagacgggcagggcttgatgtttcagccaacccgtatttaatttcattttgcacagacaatttcaagatggtactgtttcgtgacggcagagcattaatacacggcacaagtgatatcagcagagcgaaatctttttatcataaatggatcggataatgtgaaaggagcgaaaaacatcatgagcatatgcaaagcattgacgattgccggatcagattcaggaggcggcgccggtatacaggcggatctcaaaacctttcaggagctcggcgttttcgggatgtcagcccttacagcggtaaccgcccagaacacgttgggcgttcacggcatttatccgctcacccgggaggcgctgggcagccagattgacgcggtggcggaagatttgcggcctgatgctgtaaaaacaggaatgctgtggagcgcggaaatgattgcggaaattgcggaaaaaacggatcagtacgggcttgatcatctcatcaccgatcccgtcatgattgccaaaggaggcgcttccctgctgcgtgaggaatctcaggccgcgttaaaagagctgttaattccgcgcagctatgcggtgacgccgaatgttccggaagctgaggtattgacggggatggaaatccgcacgtttgaggaccggaaaaaagcggccgaacgcctttgcaagcttggggcaaagcatgtcatcataaaaggcggacatcagcctgaacaggggagaatcgttgatttattatttgacggttcgtcttttacccaaatcagccacgcttatattgacacgaaacacacccacggaacaggctgcacgttcgcagccgcgctgacggcagaaacggcaaaggggaaaaacattcagaccgcgtttgagacagctgtcaattttgtgcgggaagccgtggaacatacactcggcatcggagcgggacacggcccgaccaatcattttgcctttaaaaggaacagtctgcagacgagataaaaaagagaccgcttcaacatccgcggtctttttcccatgctttcaatctggacaaggttatgatatgataaaaattaagatcaggtactaaaactatgtctttaagacgattacaggaggctttatacatatgaatttctcacttgaaggccgcaacatcgttgtgatgggcgttgccaataaacgcagtatcgcatggggaatcgcccgttcgctgcatgaagccggagcgcgcctcattttcacttacgcgggagagcgcttggaaaaatcagttcatgaccttgcggctacattagaaagaaatgattccatcatccttccgtgtgatgtgacaaatgacgctgagatcgaaacttgctttgcaagcattaaagagcaggtcggcgtgattcacggcatcgcgcactgcatcgcgttcgcaaacaaagaagagcttgtcggcgaatatttaaatacgaaccgcgaaggattcctgcttgcgcataacatcagttcttactctctgacagcggtcgcaaaagcggcgcgtccgattatgactgaaggcggaagcatcgttacactcacttacctcggcggagagcgcgtcgtttcaaactataacgtaatgggtgtggcaaaagcgtctcttgatgcgagcgtgagatatttagccgctgacttaggaaaagaaaacatccgcgtcaacagcatttcagcagggccgatccgtacgctgtctgcaaaaggaatcagtgatttcaactctatcctgaaagaaattgaagagcgcgcgccgctgcgccgcacgacaacacctgaagaagtgggcgacacggctgcattcttgttcagtgacctgtcaagaggcatcacgggcgaaaatcttcacgtggattcaggattccatattaccgcacgttaaataacaagcagtccctttcagggattgcttttttctttcttctgattttaatcattccgtcatataaataaaacatgacagaatcggagggatgaagatgtcaaaacaaaacagaaacgcggaaaaaaaaccgctcatgtatattgttcaggcggattattcagacacgcaatcatcaatgcaggacatattaatcaaaaaaaggaaagcgccgcagccgccggaagaagagccgatgcatggaaagcgggaggaagaatgtaaaactcagcctgaaggagcagtggctgtcgaaccagaaaagcaagtacctgaacagcacagccgctcagaagaagccgttcaagaagttccggcgcaagcggagcaggacactgccaagcctgaagccgctaaaaaagagcctgaagccgctgaaaaagagcctgaagcggttcacaatgccgccccagaggaaaaggtcccgccaaagcgcgtgaaaaagccgatgagcagaatgtccattcttgaaaaaattgatttcttaacgaagctgccgcataatatgccgcggaccctttgtctgatagaagccaacgggaaaacctacagaggcgtaatcgtcggaagaaaaaataatgcgatcttcctgcggacgacaagcaacggagcgccggcagaactcgcaatagacgatattacctcgctgcatccgcttggattttaaccatacaaaaagctgcctgaattctttaatccggcagcttatttttatgctttttgatttaagaatgtgtgcggttgatcagtctcgggttcaggcaattgatggcgcagaagctatggagatcgacttcaacgcaatagttcgttttttctaaacggaatacatcgcagagagagtctttatctgtaaaatcaagaatgtgcttatgctcgtcaaaagcaataagcaggcttaatgtggcacagccgtcacagaccctttcaactctgaaaaaaacggtgttaaaacacggaccgttatccagctcgccgacatttccgaatgcggtaaacggtgatgatttagaagtgaaaagtacaaacggcactgtatcgcctaatgaaaaacccggcgataaaaggttggaatagcatccggccgggcaatcttcctcgaccgcattttgcaggtcttcaatattttctaccgcttcacgcacacagtatgttgtatgcttgctcataatatccctcctgacttcacgttttatataccggattaaacgatatcggagagtcagccgcccggaagtccgggcgggctgatgattgcatctgtaatagaaggttggaaggggattcttctttaggaaagatgcgaatcaatgactatccgtgatgctttttctctttgtgcggctcaggccggtcaacaagctccggtgaaaggcattgaatggcgctgaagcagctcagatcaacttcaatgcaaaaatctgttttttctaaaccgaagaaatccgggtcacaaggatggcagacgctgagggtgtcgccgtgcacatctacggggcgcaatactgaaagcgttgcgcagcaatcacaaactctttctgcccggaagaaaatagactcgaagcactggctgtcatccgcaaatcctccgacgttcccgaatgtggagaacaaaccgccttttttatcaaacaagagaaacgggatggtatctttaccggtaaccgtcgggcttaacagattggtatagcatccagtcgggcattgttcttcaacagcctcttgttctgctaaaatcttctcgactgcatcgcatacacaactttcatctcggccatggtgttttccgcagctcatggatttcagctccttcttttagggtatttgacttttgtctttaacaacatatgtacgcgagcctcacttggtgtgggtgaacgtctatatattcatcatatgcggagaaaataagaaaaagcagagcatttttagctctgctttttctttttagaggacaagggtgatgactaagacggcaatcagtaaatttgtcgctgttgagatcaacactgcgatatcggcatctactgttgtcacgtttacgccgcgggagttttcgatgagcaatttttgacggttgatttgtttgttagctgttagctgcaataagtcttgtgcgaccaattcagcgatgactccgtcagcaattgaagtgagagtggccgttacgactgctgcattaatcgctgtcatgactgaagcgactgcttgaacgtctgttgacgttacgttaatatcacaagagtctctgataataatcgcttcttcagaaacttgtttgttgatattcgcctgagccaggtcttggtcaaggaaggcattatcttcgccaaatccatgtccgttacagcaaacactgcatcttcttccttctttttcttctttttcttctcgcggatgttcgcattcaggatcaagtgcaacccaagagtatggtctgctttccatatctattcctccttttcttttactattattaaatgagccggccccttattttgactcaggcatctatcctgataaaaatcactattttttagttattgaccgggattttggcgtctttgccggagctgttcgattaattgttctctgcgggtttgcggatttgtctgctgttcttgcgctttttcctgctcttttttctgtttctggctttcaagaaaagcttctgttttcgcctgcatgtctttgactaatgcgatcagcatttctttttcttcatcagggatttcccgcattttatcctttgtcacgccgtgttttttgaagacattgctgacaagcacctttaaaagcggatccacttctggtagattttcgagttctttttttaatttttcgttatctgccatttgttctcacctctatttaaatatttgaaaagaaaggttaaaggatgtctagttcagcaaaaagtatatttaataattgaaacaaaatttgtacaaaggccatgatatcgtctgctgtcagtgtgattttaatattgcggctgttcaggacttgaatgacggtcctcttttttatttggcaatcatccaggatcagcagttcggttgcgatttggtcggctgtgtcttcatctgcgatcgcgagctgtgtcgcgaggataatcgccgtagtaactgaggcttgtatagaaagagcggccgttatatgtgttgtatctattgtgacattttcgcaatcaatcacttcgatcgtctgctcgaattcgttggataattgttcgtatatttgcggttgcagtgtttcgactttttcttcaaacgacataaccttcactcctttctcattcatactctatataatgcaaatgaaacgccgagcggaataagaaaaacaactaaaccgcacctatttttttaccggacaaggtgcgattcatgaagatcagggttttcgcatatgtataaagaggtcaagttttgaaaaggagtgaacaggtggttatcaattggctttcatttattctgttatcgtttgccgttttccggctggccaggcttttcgtatttgacaccattatggcgccgcttcggagcctttttcacgaggaaaaaacagaaaccgcacccgacggcacgacagaaacctacattgtcataaaaggaaaaggcatcagggcatttatcggtgaacttctcagctgctattggtgtacgggcgtatggtgcgccgcctttttaattgcggcgcagattgtgatccccgaggctgcgcaatggctgattttgctgttagccatagccggcgcggccgggatcattgaagctgcggtttctcgtcttctgcaggaataaggcggttccaccagcaacttaccgtcactttcggcataaactggcatatatgacataaggaaaggaaggatcaccatgaatcaatcaagcaaaccttcccaacactctccatacaaatcaactgtgcatcagccttacgaaaaaaaaattaagaaaaaaggctgcggctgcggccaaaagaaaaaaccgaaatagccgttttcaaaaaaaaccggagcttccggtttttttgttttttgccgaacgccggcctctgcccggcatagatcataggaggaggggatgttatgaatatatttgaatcattcataaacggtaaataccgccggcacaatcaaaatcagcgggagcatgacaactatatcttatctattgaaaaacagctgtctgagtttgatgaagcgggagcgcgctttgaggaatggatagatgtgtttgccgccgaaacagaagcgaaactgaagaaaaatgagcattctcaataaaatgaaaagaaatccgcaccggccctatgcatttatccaagccaaacaagtcggctcacatagagtatagagagtaaaggaggtgcttaaatatgggattcggatatggcggattcggcggcggctacggcggttacggctgcggcggcggctgcggatacggaggcggctatgtcggaggcggatacggctcaacatttgttcttgttgtcgtattgttcatccttctgatcattgtcggtgcatccttttttggctaaaccttagcaagactttggataagcgcgggaccgttcagtcccgtgcttccctaatgtatgaaggatagagaaggagatgcggaattttttccttgtcttacgggcacacgttccgccctttattcatacaatatcgtattactccacaaaaggaggcacaccatggataatcaattttttaaaaatattgagaagaaaacaggcgtcagcatgaaggatgtcatgaaccttgcaggatcattgcaaaatgccaatttcaaagatgaaaacacggtgagaggcgtcattcagaaggtgtcccagctggctaacaagcgtgttccgaaagaattggaagacaaaatcgttcaatcgattacaagcggtaaagagaaacttgattttggcaccatttctaaaatgttaaacaataaataggcgtcagccggccttgctaaaaaggcctttttatgtgagaagaacccggcagtgatctgccgggttctttatatcctgagtgcgctccgtctgtccgtccgaagaaggggctcgagaaatcttgagctgcgcgctgtttttccccgcctgtacgcgggacaagatacatataaatgctgcatggcccttgtcatggcgacatacaggagccgtctttcttcttcgagcggagcgggatcgccctgtctcgctgtctcaagcgcgaagtcatggggtatcgagccgtcagccgcgcctaaaatatagactgtattgaattcaagacctttagagcggtgaatggtcagcagttcgacgccgttttcatcggttttctgattctcagcggcgcgcatatgatcgacatgcgcaagaaaatcgggaatggttttgaattttttggcggccactttgacatccctgagatcatcagagcctttttccagtttgtttccctcattgccccgtttttttaaatactcggaaaaacccattttgctttctgcaaaggtgatggcttcaacgggcttcattgtccggatgcttgcgaaaaacggaacgatctgcttgatctttcctatttgaaaaggcttcaggtcaggcagtttcgtcagtgccttaatcatcgtgcaatcttccgtgattgacagcgcctttaacgtttgcagggcggattgctttaaaaataaggcgggcagcagatctttcaccgcatccgtatcatcttcattctgactcgcatataagtaggcgaggatctggcgtacgattctgcggctgtagaacgtctgcacgccacggtcggcatgataaggaatcgatgattggtgcagtctttcataaatggcccgtccggcgctgtttgtccggtaaagcacggcaaaatcatcaggactcgccccgttttgaattttctctttcatatccgaaacgatcatggtcgcttcttcttcttcatcgtaaggataaaacatcacgggattgtgaacgccgtctttgacggcagaaagtgttttttcataccgttttttatttttctttacgacggcatgagcgcttgagacgatcggatgcggcgagcggtaatttgccgttaagtaaatggtctttgctgccggataatccttttgaaaatcaagaatgaaagacgggctgctgccgcggaacgcataaatggattggtcgtcatcacccacgcagcacaggttattctccgggcttgcgatcatttgcataatgttgtactggacaggattaatatcttgaaactcatcaatcaaaatatgagaaaatctgttttggtactgcgcgagaatatcaggccggctttgaaacagttcataacagccttgggccatgtcatcaaaatcaaattgccgtttttcccgcttctgccgttcgtaatgttcgtagagccggtacacttttttctcccagtcgtccgcaagcggaatggtctcatgggggagatacgtgtttttccagcagccgataagctgcagcgcctggtcgacgggaaactctttttcatccaaattttcttcatagagcgcctttttcacatattgctctttttgccactccatttttaaaagctggctgccgttccattttgaagaatcataatgatagagtattttatagaaaaaactgtggaatgttccggtcacgagacgggagacttttccggctgccagcccgtactcattcgccatccgctctttcatttcggcgacggcttttgtcgtaaaggtcacaagcagcatattctcaggtgaaatgccgaggtgttcaatcatatgggcggcgcgggctgtcagcacccttgtttttccgcttcccgctccggcaagcaccagcagggggccgtccgtttccgtgactgcccgcatctgttcgcggttcaggccgatgccggggaacaaagatgtatcagctgcctcggatgttggtgaaaacggttcggccgcaggcacttttttcgggcttttccattctgagacgatcggtttcggattctctgaaatcgcttttcctttcggcaggcggaacatgcctgcctccttatactcttctttttctttctccgcttgtggttcctcggcggcgcatgctttttcacaggcggtgaagtctcccttttgccggtgataaaatgccggctgctctaaaatcgaaagccgcatcaagacaggctggtcacaatgtgcgcaaaaaatatttcctttctgagcttcttcaaaaaggaattggtaatgttctctagaatatgtatgtaaatgtatcgttcggttattcagtcgggcgcatttcaaaaaggggtcctcccattaaaaggtgttcatccatttgatagacaaagaatatcataacaaaagaaccgcgtttcaaaaagtaagattaagggaaatgaaaagcgaaggggaggggtacatatgatttatgcaggacggattcaaaaccagcagtattctcaatacgcaaaccgggcagcgggttataagcctgattacgccggcattacgaaagcggccgccctcgccaatgacagggtgtacagagaggtggagcgccgccaggaaaacaccgcagccgcagaaaagaaaatgcatgaggaaaaacgtaagcgctctctttcccgtctgccgcaaattatgggaaaaggccggttgataaatcaatatgtgtgaaaaagcccggaaatctccgggtttttttgagccgtatatatgaaagatgcggaaaggaatgattcaatttgagaaagctttcattattaattgcggggttatttctattcggcctctttactgccggaatgaaaccggcacacgcggcggagagctccgcagcaaaagatgtcactctcacacagctggcgccgcatgtctggatgcatacaagcatcggtacggcagacggaagtcccgtccctgcgaacggattgcttcttgaaacttccaaaggaatcgtactgattgatactccgtggaatgacagtctcacagagcaattaatgacacaaataaaacagcggtttcccggcaaaaggatgaccgatgccattgtgacacacgcccatgacgatcgcatcggcgggctgaacacactgtacaaatacggtgtaaaggtgcacagcacgaagctgaccgccgacttcgcccggcagcagggatatgaccggccgctcggagatttgaaaaacgtgacaaagctgcagtttggcgatatgaaaattgaaacgttttatccgggaaaagggcatacggaagacaatattaccgtctggctgcctgaggataagctcttattcggcggttgcttaatcaaggctttagaaacaaaggaaatcataccaactccgggcttttatccggatcagtggccgcgcgccgtccgcaaagtcatgaaaagatatcaggacatcagcattgtcgttccgggccatggcagtccgggggatgaccgtctgctgccgcatacgataagccttctgaaagaaacgtaaaaaagaagaccggcgctcccattacggagtgccggcttttttaactcttcctgatttttataaaactgaggaaagcaagtgcaagcgccaaaacggtatatcccgctatcggccaaatatgctgatgaaaggaagaataatctccggatatgacttcctgagccagctcgatcgagtggataaacggtaaggcataagcgatatgtttgaatgtgtcaccgagcaggctcacctccatccaagccccgcccagaaattgcacgagtgtaatataaatcgttccgatacctgaaatttgtttgtccgtaaacacagcccctaaacataaaccgaagaaaacggacatcatcgcaatcggcagcaagacagcgatacctgcgagaagattcatccactcggcggataaaccggcagcagcagctgcgataaaacaaatgacgatttgtaaaatggctaacggaagcatcggcagtgcgtaaccgatgacataatcggctgtttttaaaggggaagcaaacaaacgggtcaaaagggcggtctgtttgtcttttgcgatcagcaatgcagagaacatcgtaaggaaagcgaaaccgaaaacaatgagtccgggtgctaaatgctgaattttaaaggtatcaagcggcgcatttttttcaatcgccgtaaacagaaacaatagaataacaggcagtgcgattccaaggatgatagataagggatcacgaaaaatctctttgcggttgcgaatggcgaaatcaagcataaagacccgcctctccgtcacaaatcgctaaaaaggcatcttcaaatgtggctgaatgagtttgttttttcagatcctccgccgtgcccagtgcttttaatgtcccattttctaaaatgcaaatacggtctgccagtgcttcagcctcttctaaatagtgtgtcgttaaaataatcgtcatgtctccctttaatgtctcaagatttttccacaactcgcggcgtgaacggacgtccagccctaatgtcggctcatctaagaaataaatatccggtttcgtaatcatgcccattgcgatgctgaggcggcgctgcattcctcctgataaggttttggtttttgctctttctttctcttttaattgaaacaattcgagcatctcatctgttcttttttttgcttcttttttcggaattccgtagactccggctataaactctaagttttcccgtacggttagatgaggagcgatggctgtttcctgcggggacatattcaatttcggttttattttatccaaatcagtcgaaatactgtgtccaagcactgatgcatcaccttcatccggagaaaggagtccgcaaagcatattgattaatgtcgtttttccggctccgttctcaccgagtaaagcgaaaaattcccctttctcaactgagaactcaagacggtcaacggcggcggtttctttataatgtttcgttaattgcttcagctcaatcgcgtgcatttactcatcctcgctatctgcgtcgatttgcttagcgtttaaaatatcttttgcaaactcgaaaaagagttcttgtttaacaagtgcgataccttgctggtcatccccaagcataagcagtgaatcccccggatttatatcgaaaacatctcttgcttctttaggaatgacaatctgtccttttgtgcccactttaacagtcccgaatatgtgttttccttttggtgccgtcatgtttatccctccgaaatatgaattgtattttttgtatgaattgtaatacttcgtatactaaacatacattaaccttccataaaatgcaataaaattcatgaaacggtattgttttcataaaaaaagcactcctgccatatcaacaggagtgcttttgtttttattgtttgtattcctttatcatttccagatgggggatgcccgcatcgagaaattcttcgccggatgtgacgcggtatccttgtttttcgtaaaacgggaccgcctgcgtctgcgcatgtaagataaagctgccggcgcccttggctgccgccgctttttcaagcgcctgcattatgatggctccgacgcctaaagaacgatggcttttcattacgcagatgcgctctaattttccatgcccgtctttcaagcgccatctgccggctccgaccggctggccgccgtcatatatgactatatgctctgacgtgtcttcgaattgatcaatctcttcttcttccggaacgtgctgttctttaacaaagacctcttttctgacgaaaaaagcgtcgttcagctgtttttcagtttttacgatgatggattccaagcagttattctcctccgcctaataaaaatgtttcgtacacagtccatgagccgttatccagctgatagagcaggtgaaaacggtcgatgacttcttcgtgggaaatgtcttgcattttcagctgtccgagtacgtcggaatgttcatctgacgacagcttctggccgaccgtgacatgcggaacgaagctgtattccggctcgccggataatgctcctgagtagcatttctcactcagagattttaattcctccgtcggctctgctttcatatatatcacattattcacaggagaaaacgagctgtattttgtgattttcagaacgagcggatgcgactctttcgccgtctgtctcagctgtgatacgacctgctcgatttcctgttctgtcgcttcaaacggatctcttaccgtcagatgcggcggaatgagcgcgtagctcgggtcgtagcgtttccggtacgaatttgcgagatcctgtaatttttttgatggaaataaaacaataccgtatttcatgaaagttccctccttaaatgaatggttacagcatttttttcagcgccggcgtgatgagcggctgccagtaggtccatttatgatccccgtcgaaggtttcatacgtgtattcagactgtttgctttccagcagctgtttgagctcttcgttcggcgcggtgaaatcaagaacctggccgtccgtcgtgtgaacgccggtttctttttctccgatttgatgataaacggaaatctgtttgagatcctccgactgccggacggcatccagcacgtgcccgtcaacatacggagactgcatgatgacgtttccaaacatattcggatagtcaatcgccgtcatgagcgaaacggttccgccgagggaatccccgatcatggtgcggccgtatccgacttgataagtcgggtattctttgtcgataaaaggaacgagctcattggcgataaaccgcttatatgaggcgaacttagagccttctggatggtatgtgtttcttcgctcccgcacatttttataagggacgccgataatgatgcagcggtcaatttccccttttgacataagctcttccgcctgacgcccgattctccctaatctgaaataatcatggccgtcctgagcgatgaccgtatgatatttatacaggggggagaaggtggcgggcaggtagaccaaaacggtcatttcctcttcaagctcatgggagaaaagtgttttctcatgaatgattccgttttttgatgccacttcgcattcctccaggccgcttcttgtcttgatggttttttcctattgtaccatgaattattagaaatttctttcttcagatgcacttcttgcgagagttcagataaataaaaagttgttgaaatctattttatagtgcgttaatatagaacaatcagaaaatacaaaacaatattcttatcacgagaggtggagggactggccctttgaaacctcagcaaccggtttgctttgccgcgggaaggcaaagtgccaaggtgctaaatccagcaagcgattcacgcttggaagataagaggaagagaaaagctccttcttcttatgaagagggggcttttttatttttgaaaaaggatggtgcttactgatgacgcagcatgttgaaacaaaattagcccaaatcggaaatagaagcgaagaagcaacgggaacggtcagtccgccgatttatctgtccaccgcttaccgccatagaggaataggagaatctacaggttttgattacgtgcgcacgaaaaacccgacacgccagctcgtcgaagacgccatcgccgtgttggaaaacggtgcgagaggatttgctttcagctcgggaatggcagccattcaaaccattatggctttatttaaaagcggggatgaattgattgtatcctccgatttatatggaggcacgtaccgtttgtttgaaaacgaatggagaaaatacggcttaagctttatttacgatgatttcagcgatgaagactgtttacgctccaaaataacggaaaacacgaaagcgctatttgttgaaacaccgacaaacccgttaatgcaggaggcggacattgaaaaaatcgcccggattacgaaagaagccggcctgcttttgattgtggataatacgttttataccccggtcatccagcgtccgcttgaactgggagcggacatcgtcattcacagcgccacaaaatatttagcggggcacaatgacctccttgccggtctggctgtcgttaaggatgaagagctcggcgacatcatgtttaatcaccaaaatgcgatcggcgccgttctcccgccgtttgattcgtggcttttaatgagagggatgaaaacactcggactcagaatgcgccgtcatgaagaaaacgcccttgaacttgcagaatttttagaacaggaagaggaaatcgccgacgtgttatatcccggaaaaggcggaatgctgtctttccggctgcaaaaagaagaatgggtcaatccgtttttaaaggcgctgaaaacgatctgtttcgcagaaagtctcggcggggtggaaagttttattacataccccgcgacacagacgcacatggacattccggaagatatccgtatcgcaaacggcgtctgcaaccgtctgctgcgtttttcagtgggcattgaacatgcagaagatttgaagcgggatgtaaagcaggcattacagcaagtaaaagagggggccgtgtcatatgagtaatcacaattggacgctggaaacccagctcgtgcacaatccatttaaaacagacggagccaccggagccgtcagcgtcccgatccagcatgcttccacattccatcagtcttcatttgaagaattcgggacatatgactacagccgatcaggcacaccgacaagaacagcgcttgaagaaacgatcgcaggtcttgaaggcggaacgagaggttttgctttcagctccggtatggcggcgatttcgacggcgtttctgctcttatcccaaggcgaccatgttctcgtcacggaggatgtgtacggcggaacattccgcatggtgactgaggttctgtcccgtttcggaatcgaacatacctttgtcgatatgacggacacagaagcggtcgcctgcgccatccggccgaacacgaaagccatttatatggaaacaccgtcaaacccgacgctcggcatcacggatattaagggcgtcgtcaaactggcaaaggaacacggctgtctgacataccttgacaatacattcatgacgcctgctctgcagcgtccgcttgatctcggtgtagatatcgtgcttcacagcgcgacgaaatttttaagcggccacagtgacgtgctgtcaggccttgccgccgtaaaagatgaagagctcggcaatcagctgtataagctgcaaaactcgtttggagcggtgctcggtgttcaggactgctggctcgtattgagaggcttaaaaacattgcaggtcagactggaaaaagcgagccggacggctgagcggctggctgcctattttgacgggcatcccgcaatcaaaaacgtttactatcccggccttgccggacacccgggagccgatacccataaacgtcaagcgagcggagcgggcgccgtcctgtcctttgaattggaaagcaaagaagccgtcaaaaagctggtcgaaaacgtatcgcttccggtatttgccgtcagcctcggcgctgtcgagtccattctctcataccctgcagccatgtcgcatgccgccatgccgaaatcagagagggaaaaacgcggcatcacagacggccttctgcgcctgagcgtcggagtcgaaaacgccgaagatttagaacgcgacttcgaacaggcattgaaaaaaataacccccgcccaagtgagatcataaacgaaaagggtgccgtcaattttgcgacgcgcccttttttattttagataaaaaaagtgttgacgaatgagaaatcaggatatataattataaatgtcagagagacaacaacatacccagcaacacatacatatcatgattccgtagctcagctgggagagcgctaccttgacagggtagaggtcgctggttcgagcccagtcggaatcatagccaaaacccttgcgttgcaagggttttttactttgcttatttattgattttgtcatcattcatcgagttggggacgaattggggacggaactgcttttttgggccgattttgaagtacattcgctgtatacttcaagggaggtgaacatcgcctttaaggcggcggtctttgccgaaacctgttcattacagagaaatacagaaattccgtatcactgaacggctaaagtgataacgatcagcagctggttaatcctgctgtttttttgtatttgaaaaacggaatatttagttttgtatgaaaaatacagcgaaaatctggaaatcattcacagcacaggaaatgacgcatgcagccgctaatgaaatcagttatatgaccggtagcagtgaatcgactagatatcattttgccgtcgatgataaagaagtgatacagggggccctccatcctaaggcaagaaatcatacttccccttgctttccggttttttaagtcaaaagcccattaaaacccgaggggagagcgtaaaacagattcgaacggcgctgtcggccctttattaaagcggaagaacttcgggattgatggagcatatggagcgaaaacagcgaatgcagtaattcgatttcaattggtgaatggattaaaagctgatggaatttatgcgcttgaaccaaagcaaaacttgaagtgttgttaaaataagcggagactctttccttttttacagactctctcccacactgaacaagaagggttgtgttaaagcaaaatctaagaaattaaatccaaaaagattgcaatgacaagcttctaaagagatgaaaaatatcgggatatcaactaaggcgcaaaatgcaataaaacaggagcttgaaaaaagaaaagaaaaaacaaagagaaaaaataaaggaacaagaatatttaatcagaaaacaaaaagcaaaagaaaagcataggggcaaatagttggagaacccgctgaagcacttcgattgaaaagttgagcggcatcagttttttgcttcggactgatttagagaaaaagaagtataagtcagagcccttctcaagatgaggagggtttttttgcaatttatttaaattcacttacatcagtaaatgcggctgaacgattcagtacgattcagctcatgtatggtttgaagccagacggaatttgcggaccaaaaacgaaagcgaaattgaattaataaaagaagcccttcttaaaagagggctctttttctaactatgttgtttaagatgctttttaatttgttcagtgacttgcttaagccattctaatggagttatatcatcttcaggaaagtatataccatccgctgcttcctctataaattcattcttgtcttcttctgaataatcactatttacaaactcagttagtgctattaaatctctttcttttagtttttgtgatgcttcatttaaatattcatcaagtgcattttccggagactctatatcttggtgaaaatgtccgccgagaaatctaaatacaggatcagaaactttaatttcaatcattatatatcacctcgttgggtagcctgttagtataaagctaccatctttatttttctttaatactattctagcattagtcatatctttaacttcatttgaacctttacgaactcctctacctataacttcggttcctctataaggtaacggtaatggatcgttaacatcactttttaaccactcttcaatttcctttttatgtttagttaatgtttcattagcgactctttctgcagttggcctatcagtgaaactagaagaggcacgtatcttcttgtttatctgtagcctctgtaataactcttcatcagtcttcccaacatgcctttctagaaggtgtccgccttttgcttcgtgagcagctaagccaccgcctggtgcgagaggactgctgtctccttgtttaacactatgtatgccgttattgtcagaagtcacagatttactgagcacactctctttctgatcttcaataatacttttcaacaaaggagtattcttcacattgtgagtattttcaatatcctgtgctattccggcaagcgcgggttggtacttatttttcgaaacggaattgatataattttttcctttttcaatcccggtttttacatgttttgcagctgctttttcaccggcttccaagacgttatccactttggcggcgcctgttttcgcgagcttgcttgatacttttacagctgagccggaacctttgagcccgacgatgctcccgatggcgtaagtgatgtaatgggatcttgaatacgcatccccgttaaccattttatcattccacgaatccgccaggtttgtccatatgatttttgcgtaggagggcgtgttcaatacagccgatatggttttagcgactttttgttcatcggagagatggtaaaaatcccatgcgccgacagccagatctttgacgccggttatggtgtcttttcccacatcataaaggccgacgcctattcctttgacgatatcccaagccgtttctccgacttcttcaagctgttttgcttgttcaagctgcattacatattccacctgagcgggttcaaggttttcatagccgatcttctttgcgatttccaaatactcatccggatcggtgacaccatcagccagctttttcttcagatccttgatttcacgctctttcgcttcttcctttttaatcgtcaaataagcatccgaatgtcttgcgatatcgccttttttcttatggatgtcgctttcacggtacgctttggcgttgtagtgaagcggcgtggcgctttttcctttgcctgtggcgttttggagctgctgaaagtcggcttggataaactgttcgttcgcttcggtttctgcgtattctttcgttagatcgtgatcaagcttgccgagtttatgtatggtttcgcttctttttttgtcagctgaagaaagcttttgatctgtgctttcggttgaaaacaattcgagcgagatgatgtcttcgatctcaccgaggatggagcgcatgtcttttttctgcgcttccataatcgcctttgatttactgagggcatgggtgagctcgtgctccagaaaagattcttctacatgagattcggaaagacctgcgtcttcgactttgccgggaaggcttgtgagaaatgcgattttcatatcgatcagatcaagccagctgtctgtgacgccggcgtgatcctggaaaaaggctttgatattgtcagcgccccggcctgagaaatcattgtcaccaagatcagccataccttgaaacgctttttttaggttgaccatctgaccgcgcagttttttatattcacccgcacgctgtttggcggcggcgaggagggtggttgcttcgaaaactttcatgaccatatcctttcatgcgaaatacttcaacaagatattaccatggaagaatgaaggaaaagccaaataagtattttgaaagtgcaaaatgattaatttgttctgggtaaatttacttattttatgatcgggaattggggtagagttagctttaggttgaatcggttgttagaacatcatgtgacgcacttcctttaaaaagcatacacacacatattagagggctgaaatttacccgaatgaattaggatacggcggcccaaactgctttccgcatggaatcaacctgggcaactggtcaatagctttaaaaacttcatcataacagggaagtgcggcgggcattgggaatataaaggaatataggcttacagctatgcaggatggatgaaaatccgtcagacggcgaaggaaaggcaatctccatgtgttgtgacagttcgaatgcgggggtacggaacttcccattcatccgagttatgtcagagggacgaaaagacttttttgaggaggaagcggaatgattaaatttacacggccttcacctatgaagaaaacatgtacgatgcacccggaaaaggaatctgtcagatcggtttcgtttactgattttaacggcaattctgtaacagtaacactttgtcaaatgtgtctggctgaattaaaaatgaaagccgcgactgaatacaggagcatgaccgaggagcgggccaaactgaatcgtttcaagattggtgatcatgtgtatttagagcatttgggagtcgtcagcgagataaaaaacatggaaggcgctcaagtggcaaacaggacagacacagacggagtccggaaggctacccctaaggaaatcgcagaatataaaaaacaggggaagcgatgacggtgaaaaaacgactcagtcaattatttatcagttgtgttacttatgggagcgggggccggatgtttacgggtgcgcgacttacacggccggagcctccacggtggagaggaggagaattcaaactaagaatgtgaattgatcaaacgcagtttcatgaatcttcgaaggctttccatccgaaatttgggtgcagtatgggaaatttttttgtggaaacttgacataatgctgtcaggtccctattgtatgattaaatgaatggccagtaaaatgataggaggcgttcaatatgaaactgctgcaaattagactattggttaatgactttaaaaaaagcgtcgagttttataaagattcattaggacttccaataagttggttagagaaggaaatggaatatgcacttttcgataatggagaaacgaaaatagagcttttatctcaagaaaatatggctgaaatagttggagaagaaagaaaatctttagacggagattcgcaatcgagatttttgcttcaatttaaggtagaagatgttgataaaacgtatgactatttgcacaagcaagggattacatgcgtcaatgaaccacatgatcgtcaggaatggcgtgcacgagttgctcatttcagagatccagataataatcttattgaaatatataaaatgatataattttgaccgcgagattaaggtaatgcgtttgttaacttaccttatgatttttatagtctgcaagagaaacatatatagatccaagacggaaagcctgcggacactgatcattgcacagctcactatgctctgattggtgtccgtttttatttgcacggagggataacaaatagataatgaacacgaagcggacatgcaaacattcagacgcggcaagggcggcgcatttaataaggggaggaatcagaatgcaggatttaatcattcacaggaaatatattgactttcatcctgtttgtaatgttaattagaagatgtatacaaaaacattataatgaggaggtctggatgtgaaaaataaagcgggaatacaagttggaatatgcattgggcttttatgtttaagctttaccggtttcagccctttattcggctctacgcacgctgaagcaaaatccatagaaaacacaaaaatgacaagctgtataacgaatcaaaaatttgttcagcttgagaaaaaatttgatgccaggcttggggtttatgcgattgatacggggtcaaacaagacaatcgcctatcggccgaatgaacggtttgcttacgcatcaacctataaagttctggctgcagctgctgttctgaagaaaagctcaaatgaaaaacttaatgccatcatccgctacagcaaagacgatttagttacatattctccaatcacagaaaaacacctggatacaggcatgagcctgaaagaaatctcagaagccgctgtccgttacagcgataatactgcggggaacctattgctgcagcagcttggcggccctaaaggtttcgaaaaatcactgaaacagattggggatcatgtaacgaaagcggatcgattcgagacggatctaaactctgcgattcccggggatcgtcgtgacacaagcacagcaaaggcactggcaaccgatcttaaagcgttcactttgggtaacactctcacgactgacaagcgcacgatcttaacggattggatgcggggcaacgctaccggcgatgaactgattcgggcaggcgctcctgcaggatgggaagtcggcgataaatccggagccggaagttacgggacgcgaaacgacattgccatcgtttggccgcctgacagagctccgattgttttggcaatcctgtcaaaccgatttacagaagatgccgattatcataatgctcttatcgctgaggctgcaaaagtcgctcttcatgatcttaaataaacattgccgttcattttttatggacggttttttatatgttgagaatgcggtatgcgggtttcgatgttataatgtaaagccataaaatgatgggaagagggggagtttcgatgcattacataacggcatgcttaaaaatcatcagtgataaagaccttaatgaaataatgaaggaattcaaaaacttgaggaagaaacgaacaaagaagaaggctgtattcagttccatgctcatccgcttgaaccatcagaacgcaaaattatgctttgggagatttgggaaaacgaagaagctgttaaagtccattttacgaaaaagcacacaaaagacgttcaaaaacaagaattaacggaagtagaatggttaatgaaaagcaatgtgaatgagtaaaaggctttgtatgttgttggctgactctgccggcaacaatcatcagtttcattcattaaaacccttgctgcgcaagggttttttactttgaaaagttctttatatcgcagtctttttatgggtaaggaacagacttggaatgaagatggccgcaaggatgatgacggatactaagaatccggcatggtagccttttaaactgttcggaatcgttggctgcaatccttgtatgacagttgcggtaacggttgcgatcacagctgacccaaagctggaaccgaggttttcaatcatatgaataccgacacctgcttccggaagctgtttgctgtcaagacctgtataagcgtcactcattaatgggagcataattcctccaaaactggtgccgcggataaataatacgacggaaatccaaatcatacttgtgttatcggtgataaaaataagcgggatagatccgatcagcgaaagaacaagactgaccgtaaccacgtatttcgcaccgatcttatcaatcatttttccgatcagcggacgagtcacgagcattccgactccttgagggattaaagcgagtgctgctccgactgccgtgaaatgacgaatgtcttgaaaaaacagcggaagtattaacatcggccccatgatggcaacattcgctaagaacaacccgatcgaagatgctaagaagctcttgtttgcaaacaaattcataggcagcacggtttggtttttcttgatcagattatatacaagataaatgactgctgaaacaagaccgatgcccgcccataaaatggtgtcgctattgttaaatgatgcatgatccgccgctttcgtaataccgtacatcaatgccgcgctcattaatgacaaattgataatcccgaaaatatcgagtttacgatctttgttgaatggttcaaagtctggaatggttttcatcataagcggtgcggcaaccaaaacgatgaacacgttgatgtaaaaaatccaatgccatgaagcgacttggacgatgaagcctccgatgacaggtcctaagatcgggccgaagatcataggggtgctgacgattgccatcacttttcccaggttttccggacctgccgttttaaccaagagtgttgacataagcggagtgataatgccggcgctgaatccttgaagcaaacggaagaagatgaagctggaaacgtcacggctcattcccgcaaaaacagaaatgacaccaaaggcgatgactgagccgatgaagattttcttaccgttatatttattcataagccagccggatacgggtactgcaatcgcaagtgctaacatatagcctgtaacggaccactgaatggtatccaatgtcgtgttgaagtctttggtcagtttgtcgatggcgatgtttaccatcgtagagtcaagcattggagcaattgctcccagtgcaatagcccaggcggctgtgagaacttcttttggcagccgaagttcctttcttttatgtgttgacatattattctcctctcaaaatcgccgtatttgtttccttgtcaacaaaataatagagtgattttgtttctttgtcaacaataagagggatataaaaaggcagcccgttttcatggagcagggctgcctatggttttattccgatttcatgtctgcaccaagtttctttatttctgaatccaaatgcctgctgtatgtttccacgaagctcagcatcgtgtcaaattgttcatcagttacttgttcaaacacgattttgtcccgttcttgaaactctttgtgcaattcctcgtgaattttataaatgacttttccttgctcggtaagcctgaaatagatttctttcttattaagcggcttctgatagctttcgataaggcctttattgataagcttcttcgttaatttacttatagcgcctcttgtcatataaagggactccgcaagttttgtcacattggcgtcttcaattttttcgatgaattcgatgcaatgcacttcagaaggtttatgccccttaaggctttcttccatcttcagcctattcagccacaccatcttgttaaaaaagtccctgaaatccgtgaggagctgttcttttttgtccatgacccgtcctcctgctcggtggtgcttacacaatattataaaatgtttgtttctttttcaacaatcgtaaagttattatttaggaactgagagatagtgcgcagaaataagaaggagggggaacagaagaagtatcctatttttaaccgaaatgtggtttttcgagtatgtttctttccgtattcgttattagctcttcataacaggctaactctgcagccttacaaaaaagcaggctgcgaaaagagcctgctttagaattgcatcaatcattttcctgttgcggcatcataaaaagcgtcaattgcggttgtgtatttcaagacgtttttagacacttttgcggttgcgcctaatggatacgcatctgacagaacgctggagtgagcttcgggttcccagtaaaatacgccggttcctttgccgttcggaacggctttcaccagttttatggtgtcttttatggtccagtaggaatctttcggattattttcatctccgcccagttcaaccaccatgacttccttgttgtagcgtgaggcgatgtcattcaaattagatgataaatggccggtgagctcccagtacggcttaccttcccaatagggatagaacgaaacgccgatgatgtcggttttccctccgtttttaaagaattgatcaaaccaccatctgaataggctgttgtccgtgccgtgtgctaaatggctgattaccttggtggccgggctgacggatttcacggcgtcatagcctttgttcagtaagccggtcaatttgctgaaatcgctcgtgctgccgtcgggcagtaaaattcctgaattcatttcatttcctacttgcacccaatcaggagagatgccgtgatttttaagttctttcatgacatcgtacgtatggttatacacggctgcctgcagctggctgtttgaatagccggtccattggttcggcttgatctggtggccgggatcagcgaacacatcactgtaatggaagtcaaccattactttcattcctaacgcttttgcccttttggccgccgcaagtacgcccgctttgtcactatagccgagcatcgtccatgttgtgccgtctttcagccaataatagctgcttggcggattcacaaacactctcagtctcacggcatttattccgtgatctttaagaatctgcaaggcatctttctgtttcccgccgtcatccagccagcgcacaccttcatcctccatttgtttcagccatcctatatcagcgccataggcaaacggggcatccgcttttgctttaggagacttctcaagaaatgtaaaagcggtgaaaatgagagaaagacagattgcgtttacaaatacacgtttcaatcggtttttgaacatcacaatacctcctgataaaaaagattgttgattgatttcactctgaatgtttcagctgtcattctccaataacgtcgtgaaacgctgaaacgcctgaattccttcgggtgtcattttaaaaacgcctgcatcggtcagcgcgcgtaaaaatacattcgcggtttctctttgtaaaacagcggctgcattttccggtgtcacgtctttatccgctttgatgttttcagcccacggaagatgaatgtccttgatgtcatgatgttcattcagtaaatactttttcacttctgccagctcatctttcagacggggaggtaaaacggcgagccccatcacttcaatcagaccgatattttcttttttgatgtgatgaacgtcttgatgcgggtgaaaaatgccatccggataatcttcggaggtgcggttgtttctgagagcgagatcgatttcaaaatccgttcccctgcgtctggcaatcggggtgacggtattatggggttcatttgtcttcgcgatgatgctgacggtttcgtctgaatattcccgccacttttcaaaaacatacgcagcggcatctgtcagcaaatccggatcttttgcgcgaaggcggatcactgataccggccacttcacggcttcggcctgaacgtctggaaaatgacgcatatgaaaagggtagagggaacccgcttttgccatgggaaactcatgggcgccgccttgataatgatcgtgtgaaagaatggaacctcctacgatcggcaagtctgcgtttgatcccgcgaaataatgagggaaaatttccgtaatggccagaagccttctgaagctttcgcggctgatgttcatcggcttgtgcacgcttgaaagaaagatggcatgctcgctgtaatacgcataaggagagtattgaaaaccccactgttctcccgctaagtcaagcctgatgatgcggtggtttgaacgggcggggtgatgcggtgttccggcatacccctcgttttccatacagagcagacatttcggataccggttttccggactgttttttaccgcggcgatgtctttagggtctttttccggttttgatagattaatggtgatgtccaattccccaaaaggtgttattgagcggtacacgatattttttcgaatggcccgcgtcttaatatagtcgttgttttgactcaatctataaaaataatctgttgcttttttcgggcaatctgataacaattcgctgaatgcgtcattgatcagagaaggggccggtgtgattacgtccatgattctgcttcccagcatgtctctttcagccggcgtatcgtttatgattgaccgttttaccgcgtctttcaccatttcgtccaaatagtgaagcctgttttgtttcttgatacgtttcggttctgcataatccgtcagtccgagcagatcgagaagtctgtttcttgtataaatcacatctgtttcatttatgtcgcctaagacagtgctttctttcagaaaccctgccactgattcaaaaacgtcaatgaccgccgcctccatttcatttgtccttgtatccgttaggatgatgccgatgccaattccatgctgacgcaatgatttccgatatgtccgtttgtttcggattccagccgagaatgttccgcgctttatcgctggaagcgatgagggcgcttggatcaccgggtcttcttgcggacgctcttacttttatgtctctttcggtcacttgccgggccgcttccgccatttctgatacggaaaacccgctgcttgatcctaaattgaaaatgccgctgtctccgccgttttgcaaatattccagagcgagaatatgggcatcgattaaatcagaaacatgaacataatcgcggatgcacgtgccgtcttttgtatcatagtcagtgccgaatatcaaaacctcctcgcgctgaccgagcgcggtttgtaaaaggatagggataaggtgggtttccggatgatgatcttctccgatggaaccgtccgttttcgcgccggcaacgttaaaataccgaagcgagacatattttatgccgcaagcggtatcgcaccacttcagcattttttctgccatgagttttgattcgccgtatgcgctttccggcttttccggcatgtcttctgtgatgggcgctttttcaggttcgccgtaaacagcggcggatgaagaaaacacaatgtgtttcacttcgaattcctgcatgacctccagcgtaatttgcgtaccgtacacattattattgaaatatgaaagagggtctttcattgattcgccgacaagggattgagcggcaaaatggagaacgcctgttacgttctccttcgcaaatacagagcgaagaaacggtttgtcacggatatctccatggtaaaaaacggctttttcatgaacggctttccggtggcctgtctggagattatccacagctatcgtttcaaatcctttgtttactaattgatcaaccgcatgagaaccgatatagccggctccgccgagaacgagaatcgccatgatttatttttccctccattcagccgcgccatcgcttatatccgcgatgtagaaagaagcttcaagacctgtcctgctgcggtagtgagatgaaacggcccggataaagccggcggtttcttcactttccacaatggctatggcgcagccgccgaaccccgcgcccgtcatccgcgctccgagtgctccttctttccaggctgcttcagccagcgcgtctaattcgtcaccggtcacttcgtagtcatcacgtaacgaacggtgcgacgcattcatcagctccccgaacgttttcaaatcattcgatttgagagcttccgccgctgagagggtccgctcgttttcattgaccgcgtgccgggctcttttacgcaaagtttcacgggagagaagaggttcgagttcgttgaattcttctcccgtcaattccgcaagtgatgcgatattttgatattgccgcagttccgtgagagccgcgtcgcattcgctgcggcgttcattatactttgaagccgccagctcccggcgcttgttcgtattcataatgacgattttatatccgttaaaagcagccggaatcatttcgtgctcaagcttatcgcagtttaacagaatggccatgttctttttgcctttttgcactgcgaattgatccataatccctgaattcacgccgataaattcattttcgactctttttccgataagcgccagttcagtatcggaaacatccaggctgaataactttcttaaaatggaaccggttaacatttcaatggaagcagaggagcttaaaccggctccgtttggaatcgtaccgtgaaaaagaatatccattccgctgtctatttggccgccggcttcaagaaggtaatggaccatccccttcggataattggcccagccgtcttcttttttgtatgcagtggcggaaagatcaaggcagacaatgccgctgtcaggaaagttttctgagtataaccggatctggtgatcttcgcgttttgcgcatacggcatatgttccgatcgtgatcgcgcatggaagaacgtgaccgcctatataatccgtatgttccccgatcaggttgatccggccgggtgcgaaaaacagttctccgttacttctcttgaaaatgtcttcgaatcttgatttcaaaagtttggcatccatggtaaacctccgattctattttgaggtatgctccagtatgaactgaatggctttttgtgaatttctggtgaggctgatatattccgctcctttcgttgcgacgagtttcacatgcaggcggtccgcatcttctttaatgtcatcataataagagccgacttgcggagccaaaatgatcatatcgaagtctttcatgatgtcgtaatgggatccgtaggcgcctgctgaggcggtgatcggcacgttgtattcttcggctccttcggtcagtgcgttcgcaagcatagcgctcgttcccgctccggcgcacagcactaacacattggtgccgtgttccaaggcggatgaggattcctgaagatttgtgctgatgacggtggccgcgtcttctgaggcgccggccattacgggctgtatctcccgggatttttgcggcgcggtttcaggttcggtatgttgggcttcttccgccgctaatactttgtcataagctttacagaatggcaggtatatcaggaaatcgacaataattaatacagccgtcagaacaaaagccgagagccccatgccggttccgagaatcaagccggcgggcgccggggtggcccacggaagaacatacataaaactgttcattccgatgacatccacgaaaaatttaaacagacagacattcaccatcggcgttacaacaaacggaatgaaaaaataaggatttaaaatgatcggcgcagcaaagagaagaggttcgtttactgcgaaagacaccggaaccgcggatgcttttccgactgctttcaattgcttggatttcgcgaaaagcagaaagataaacggaacaacaagggttgcgccggttcctcccattgtgccgacgaagttcccgagtccgacggtcagcacgttggacgcctgctcgccggcattatgaagctgaaggttcgcctccacatttgcgtaaataatagctgcgatggccggctctacaatagaaggcccgtgaacgccgacaaaccagaacagcgccatcattccccaaatgacacaaatcccgagataaccgtctgcggcggtaaaaaatggcgataagagagaggagagagcctccgcaaacgatacattcagcgtattcctgatcaataaatcaacgatcaccatggccaaaacggaaaaagcgaacggaaaaacatctttaaatgtttgtgaaatggtacccggtacttctttaggcattttaatcgtaatatttttcagcacgcagaatctgtaaacgttcaccgttatgaaagcggatacaaaagcggctaaaagaccttttgtgccgagatattccgcggagaacccgccgtcgatttgagtgacgcttaaaatgagaaacccgacgactgaagcaagcatcgctgaaacggggttgatccctttgtttttcggcatttttcggttcattgattcactcaggcatttcgcacttgttgccgcaacgatcagaccgagggcgcccattgaatagttataaactttccaaagccattcagaaacacttttaggccaagtgaaacccaacacttccggcacagcggcggtgaggatgaaaatgctggcgaataaaataacaggcatggcagttaagaagccgtcgcggatcgcgcctaaataaatgtttcttgagattttttcgaaaaacggttttcccttttcgatttgcttgatgataccgttcatttttccactccttatcggcggcttcggtagagttctataaaatcctgaataagatcacggagcaaaagggttgtcatcaagtggtcctggccgtgaacgaaaataaaccctaattccatgtccttgccgtcagcttcttcagctaacattttcgtttgcgcattgtgggcgagggttaaattttcatcggcgcttttcaatgctgcttccgtgttttcgaagtttccggcacggacttctttcaggactttcaataaagtgctcctggcgtcgccggcataggcgacgatttcaaaaccgagcatctgcaattcttcctttgtcatgaaaaaaacctcctaaagacggcacacatgatggaaagagattcttttcatcatgtatgatcgttaaatgattgtttttgtttcacttacaagtttgtaccagtaggccgattctttcggataccgtttttgggtgtcgaagtcgacgtaaaaaagaccgtaacgtttgttgtagccgttggtccatgaaaataaatccattaaggaccataagaagtacccctttacattgactccgtcggtaatcgctttactgacggcttctaaatatacttttaaatagtcgattcttgccttatccataatgatgccgtcttcaaactcatctttatagcccatgccgttttcggtaatgtaaattttgttatattgcggatagtcccgtttgatgcgcatcagcatgtcatacatgccttcagggtaaatgagccagtcccaatcggtccgcttcaggccttctttgtaaattcgttcgccgattccttttactttatagaccgaagtgcccttatcgcccgttccgttatggtgaataacggtttctccgtcgtacgctttgacgaaatggcattgataatgattgatgccgagataatcattgcgcgttgaggcttttttcatcacgtcaaagtcactgtctgaaaactcgtatgaagcgccgtttgcctcacagatttcatccagagcacgcatggtttcctcagaataatagccaaggtaggtggcatcgaggaggaatctcactgataacgcgtcatccagaaaacaggcgtggcggtcttcttctgtgccgctggcgggatattttgtttccaatgagtggacgaccccgatttctcccggataaccgccgtctttaaaaaggttgacggtcatcgcatgcgctaccatcatgtgatggaggcattgaatgacttttgtgatatcacttttaacagatggcgggaaaaccccgagtaaatactggttggtggctgtgggataaatttcgttaaacgtgctccaatatctgatttcgctgaattctttaaagcaaaactccgcatagctgacgaacgcttctattgcagcgcggttgaggaaatctccctgatcaaataatcctttcggtgtatcgaaatgatgcagcgtgacaaaaggggtgacgttgcgtttatggcactctgagaaaatacgatgatagtaatcaacaccttcctgattgattttgcccgtgccgtcagggaaaattctcgtccaggctatagaaaggcggatgccgtttattccgaatttttcacatagtttaatatcttccggaaactggcggtaaaaatcacttgccggatcagggctgaatcttccctgtttttcaagaaattcatcccaggccacagggcctttgccgccttcttttgtggcgccttccgcttgatatgccgcagtcgccccgccgaaaataaagtcatgaggtaatttgagcattactgaatcctccttcgccaatgtgtgaattggagtttgttaatgtttgtaattgttgtcttttgtttaatagtaaacgcatatatttttgttgtcaatagcttcataaagaaataacatctgtgtttatagaggttatataagtttttcgttgttttacatgttgattatgttgtttgttaatgtttatttttgttgaccggattgccgcagtatgttagattgtgtgtaaagttgaggggatgattgaacatgttaaaaaaagagcgacttttaaaaatcatcgatatcgtaaactcgcgggggtttattacggtgagtgatattatcgatgaactggaagtttctgatatgacagtgagaagagatctggacgagctggataaggccggaaaaatcgtacgtattcacggaggcgcacagagcatatcttattccattgatcacgaattatcgcataatgaaaaactcggtgttcaaatggaggagaaggggaagatcgcggaactcgcagcttcctatgtaaatgacggcgataccgtttttttagggcccggcacgacgattgaacttttagcgaaacacctgctgcataagcgaatcaggattatcacaaacaactatcccgtatttgatattttgaaacatggcgacactgcggataccatcctgattggcggcgacttccgaaaaaataccggtgccttcgtcggccccatcgtgaacggcaatctgcagaaattcaattttacgaaggctttcatcagcgccaacggcatacataatgatgagatttcttcttacagcattgaagaaggggaagctcaccaaatcgcgctgaataattcgcggacgaaatttttgctggcggataataaaaaatttaaccgggaagatttttacgtgttctataacttgcacgatatggactatctgattacggatgataaagtcatgaaagatgttcaaattcattacgagcaatatgtagatgtcaaaatcgcaaaaaaataaaaaaggcgggcggttcgatgaaaggggttatttttgatttcaacggcacgatgtttcaagattcgcatctgcacgaaaaagcatggtttttcatggtgaaaaaatacgcgccgaaaaccatttctgatgaagacattttcgttaacattcacgggagaacaaacagtgaaatcctgacgtattttatttccggcgatttaacaaatgaagaaatcaggaagctgtcttttgaaaaagaagcttactacagagaattatgccttgaaaacaaagacgaattaaagctgacgaagggactgaccggcgtattgaatcatctgaaaaaatctgaaacgccgatgaccatcgctacggctacggtaaaggaaaatgtcgagttttactttgacgtctttcatttggatcagtggtttgattttgacaaagtcacgtttgatgacgggagcttccccggaaaaccggcgccggatatttttctcatcgcatcggaaaagttaggcctcagacctgaagaatgcttggtcattgaagatgccttttcggggctcacagcggcgaaaaaagcaggtgcgggcaagattatggccattgacccgcacggaaaaaaccgcgcgctatttgaagaaaaacagctggcgggtgacgggatactgacagatttcacctcgttttttgaggtgattgccggacattctgtttgagagatgcagttggattgagagtgatctttactttaatgtgaaatgcctttggttgaagctattatgagcttcattaaggattcattgagaggtgttattctatattacacttatatactaaatttttagtaaactgttggccaataaccgagaagtgaaaaccaaatcacttttaaatccagaggcctttttcaatatttctttgatcgaaagtaagtgatcttggatcgcttagttaaatgaatctcttgtcatacgatcgccatctataaatggaattatcacaaagatgagaggaatgaataaattgacagagaaatatgacaagtggacaagattacttgatatgattgaacctaattatgcttttgaatcagcagttgtgggtaactctatttatgtattgggaggtgcacgtaatcaaaaatataacaaaaattatagttttgacaccataagtcaaaaatggacgcaaggattagatatacccacacccagggtaggttcatgcacagcagtgataggtaattatatttatgtattgggcggttataagggagcaaatgtttacagctctgtagatgtttatgatactaaaacaaatacatggggacgtgtacctgatattccgaccccgacttgccatgcatcagccgctgttattaacgatacaatttatttgattgggggattcgacaccgatgctgctcattcgcaacattatgcttttgatactttatccaaaacttggagtgttaaaaaagcgcccccaattaatatatatgcaacagaaactgaagtttttaacggaaagatttatttagttggcgggcaaactaaagaagtagttcaaggacatatcagaagcgatctaaacgaatatatttacgaatatgatcctgttatggatagatggaatcgcaaaaaatttttaggacctttgcaaaatacttcgacagctgtccttaataataagatttacattattggcggtagaaaaaatccaagtgtgattgagcctttaacaaaagtatatgatccaattaaagatgaaattagcgtagaaaaaccctatccttttgaaagatatgatgccagaatagccgcagttggagacaatctttatctttttggcggtctaacgccgtctggatatgcattagaatatctgcatgctcttactccggtaaaaaccgaagaggataaagatggagaaccaaagaatcctgaggaaccaccaaataaacagcccgccagtaatcgggcaattcttcttgttacaatgaccacaggtcttgagaaagaatttgatctttcaatggaagagattaaagattttatcagatggtatgatcaaaaaagttctggaataggcttatctagatatgttatcgagaagcactataataatatagggccttttcaaaatagaagggaccatattgtttttggaaacattcttacttttaatgtgagtgagtacactttagataaataattacctgttttccttctgcagccctcttttttaaaaagagggctttttttatgaggtgcttattctttttcagttgcgcttttgtttttgtataatgattttctcattgaaggcggcattttttgcatcagaaaggtgttcgccttaattgaaatattggctgaatttatagattcgcagagataagggagtcgtaaaagatatgccgtttgcggatttcagcctgtcttttgagaaggatcattcttcaatgacgcttatttcccccgtaccgaaaaaaagtgaaacacgttctcctcgcttttcataggttttgataagtccttcctgccctttaagtttccagcctttttcggctatttccaattggtataaaccgctcggaccttcttcttcttttgcgaaacggtatgtatagtttgaaacgtattttcctttttcatattcctttgttttagtgtgcatagcgaataatggcaccgggaaatcagggtgagaaacagctgctttatatcctcccaaaataaataagctaaataacaataatataaaaaaccacagaatatatttcataaaacctccttatgtcaattagtcggtgcattttaaaaaaagatacaccgcatgattgggttataaaagcgggtaagaagataaggaaaggagagagacggatggaacttgattttgtgattcgtctggcggttgcgggtctgcttggggctcttattggattggagagagaattcagggcaaaggaagccggtttgaggacgcattttttagtggccgtcggcagcgccttgatgatgatcgtttccaaatacggcttttttgatttgttatccaacagccatacgtcctttgatccgagccgggtggcggcgcaggtcgtcagcggcgtcggatttttaggagccggcacgattattttgcagcggcatgtcgtgcgggggcttacgacggccgcggggatttgggctacgtcggggatcgggctgacgatcggggcaggtatgtatgtcatcggcatcagcggcacgattttggcgttaatcgggcttgaactgttaaattttctgtttaaaccggcggcgcattctttgtctgtcagtttcaggattgaagagaaagccgtcatgcatgatattttaacttctcttgaggaaaaaggaattctgattacgtcctatgaattgaataaggcggtgcttgaagtgaagggaagggtgaaaagcaaaagcgggaaagcagcggtaatggagaaagttcaagccctcccgtatatcctgtcggtcaaagttgaatagcagacaggggaagcctcctgtctgcagtcatttcttttcaaacattaataccaaggatagaacgggatatacggccgcggatagtatgggtatggtctggggtaataataaggcggccgcggatagtatggatatggtctggggtaataataaggcggccgcggataatgatatggcacccgttcgtggctctcggctgtgtattcatgatcgaaaggatcgtacaagaggaaaacctccttttcaaatgttggttccgtttaccttattcctgtatgcccggtacggtgtatgtacaatgggcaaaaaaaagacgccggttatcatccggcatctttttttacactttcacatcaattgaatggccggcagtcgggtgctgggacggcagcattttcactgtttcttccgccgcagcctgtgcatgctgcatgaccgtttttgttaaagcgatatttacattctgcgccagagatgactgatgcattgcgattgataacgcagggatatccatagcttccacctccttatcccttcatatcggcggcgtgctccgattatgaagagggctggcggtttctttttacggcccattctaaaagtgcggcagcgcataccccgagggtataggcgaaaatgtcactccagacaaattgccagccgaggatcagcccgccgagcgtgctgcttctgatcgcgtcaatccatggcgcgtgatacagctggctgcattcaatcagacagcaaaacgagaggctcaaaattgcggctgtttccgtccggatgtgccgtaagaaaagcccgaatcctgtaaaaatcatggccgcccacaaggcatctcctaaataagcgtttatgatgccgggcaatagggcggtgatgtatgcggttctggacagcaaaccgagggcgatgataaaaacggtacatattccgtatgtcaatggatgtctattcacttcacactgttcccctttttttgtactcccatgtattgtaaggaacgacggagaagctgtctatgaaaaaacggcccgggaggccgcttttttgcgttatctggcttttaggttgacatgatctgctttttgatcactgccgatgacgaagcggagctcatactgccccgtatggtagacgtaatctgtttcgcccgtttctggcactgtcaggattttgtcagcgctgccgatttgtttgcttaagacgtcaggtgtgacgctgccgaggtttaagcgccgctcgacccccgttccaaaatagcgtatttccgagatttttccgtttttatgataggaaaatccatacccggggtttcccatgttccagctgtataaatcaaatggattgcggctgtctgctttttgttccggctcgccgattttattgtaaacgtcctgtcttgtgctttggttgattttcaggcctttcacattttgcggcatttcccctttaaatgccgattggtaaaggctgttcaccagttcttgtgcacgctggttttccgtttttgaagcggctgcggcatggacgggctgtgtatccgaaaatgcttctgctccgaaagcgcatcccgtgagcatcactgccgataatcccgtgacgagtgtttttttcttcaacatgtgaacgcctcctttttaccgctcatacccgtatgtttcctgagataaacgagatgttttagtgaaaggccggttgggaatcatagaggatgtatagaggggtacagaaaggggaaagaaaatggctgatacaaagaaagttacaatcaatggggttgaaatggaagcgccggacggccaaaccgttttgcagcttttgaacaatagttcaattgacgtgccgcacgtgtgttatcacccgagtctcgggccgattgaaacgtgcgatacctgtatcgtcaatgttaacggggaactggtgcgttcgtgttccgcgcaaataaaggacggagatgtcattgatacgctttcgtccgatgtaaaaaaagcgcaggttatcggcatggacaacattttgcacaaccatgaattgtactgtacggtctgtgattacaacaatgggagctgcgaaatacataataccgtaaaggaaatgaaaatcaatcatcaaagcattccgttcgatcaaaaaccgtatcctaaagatgaatcaaatccgttttaccgatatgatcccgatcagtgcattttgtgcggacgctgcgtcgaagcctgtcaggacgtacaggtaaccgaaaccttaagcattgattgggagcggaaacgcccgcgggtcatttgggatcaggatgtgccgatcaatgaatcatcatgtgtttcctgcggacattgttcgacggtatgtccgtgcaatgccatgatggaaaaaggcatggaaggcgaagctgggtatttaacaggcattaaccaagagacgcttcggccgatgattgatatcacaaaaggcgtcgaaaccggatacggatcaattttagccatatcggatatggaatcggccatgcgggatgaaagaatcaaaaaaacgaaaaccgtatgcacatactgcggtgtcggctgcagttttgatatatggacgaaaggaagagacattttaaaggtcgagcctcaggctgaggcgcccgcaaatggaatttcgacgtgtgtgaaagggaaattcggctgggatttcgtcaatagtgaaaagcgccttaccaaaccgcttatccgggaaggagactcgtttcgggaggcggaatgggatgaagcgctgcagctgatcgctgataaatttaccgatataaaagaacatttcggcccggacgcgcttgcgtttatcacatcttccaaatgcacgaatgaagaatcatacgtgatgcagaagcttgcaagagccgttatcggaacaaataatgtcgacaactgctcacgctactgccagtctcccgccacggccggattgttcagaacggtcggatacggcggtgattcagggtcgattacagatatagaaaaagctgagctcgtgctgattatcggttcaaatacatctgagtctcaccccgtcctgtccacacgcattaaacgttctcataagctgcacggacagaagctcgtcgttgctgacttgcgaaaacatgaaatggccgagcgctccgacgtgtttttccagccgcgtgccggatcagatattgtctggctgaatgccgtatcgaaatatctgcttgatcacgatttggcggatactgcatttctgaaggagagagtgaacggattagatgaattcgtgaaaagccttgaaccttatacgatggaatatgcggaaaaacataccggtgtggacaaggataccttaattaaagtggcccggatgattcatgaagccaaaagcgtatgcgcactgtgggcgatgggggtcacccagcatatcggaggaagtgatacgagcacggccatttccaacatgcttcttgtgaccggaaattacggcaagcccggcgcaggctcatatccgcttcggggccataataacgtgcagggagccagtgatttcggcagtatgcctgacagcttccccggctatgaaaaagtaacggatgaaaaagcccgcaaaaagtatgaacagggctggggaacagacctgccgaaagaaatcggaatgacaaatcatgaaatgatcgagggcatccactcgggaaaactgaagtgtatgtatgtaaaaggggaagaaatggggcttgtcgactccaatatcaaccatgttcatgccgcctttgaaaagcttgatttcttcgttgtgcaggatatttttctctcgcggacggccgagttcgccgatgtggtgctcccggcaagcccgagtcttgaaaaagaagggacgtttacgaatacggaacggagggtgcagcgcctttacgaagtgtttgaaccgctgggcgattcaaagcctgattggcagatcattacggacatcgccaaccggctgggcgctgattggcgctatgaacatccggcagacattatggaagaagcggcaatgctttcgccgctctacgtaggcgtcacttacgaacgtctcgaaggctacaattcactgcaatggccggtagcagcggacggaaccgattcaccgcttttatttacggacaagtttccgttttcagacggcaaagcgattctatatcccgttcagtggaccgagccgaaagaatttgatgaagaatatgatatccatgtgaataacgggcggctgctcgagcattttcacgaagggaatctgacttaccgatcaaaaggaatatccgaaaaaacaccgagtgtgttccttgaggtctcgcccgaactcgccgaagaaagagggctggaagacggaacgcttgtccgtctgacatcaccgtacggaaatgtgaaagtcaaatgcgtcatcacagacagggtaaaaggcaaacaagtctatctcccgatgaacgattcaaaagacgccgccattaaccttttgacaagcagctatgcggataaggataccgatacaccggcatataaagaaacatcagcgaagatggagattttgaaaaaagaaggcgttaatccgcttccgaaaatcaatttccgttacggaaacccgcagccgcagatcggtgtccgggttgatcggaaatgggcgcgtcaagattatgtatttccgggagacgccgtaaaaagggggaaacagcagaatggctaaagcaatcagcggcatccgaaaacagaccgtcacagaagaagacaaacgaaaaaaggacttagaagagatcgagacggctcttttacgaaataaagacgcgattttggaatctctgcacattcttcagcacatgaacgagcgcggcgttttggcgcttctgcgcgggctcttcggccaaggagacaaagtgatggatatcctggtgaagaaggcgaatacgccggaaacggccaatatgctgaaaaatctcctgctgttaagcggcgttctcggcatgctcgatgtaaaacagcttgagccgtttatcgttaaaatcaatgcgggcgtcacaaaggccgtcgaagaaaaagacagcggcaggaagacgggttattttgatatcgtccgcgctttaaaagacccggaaatcaacaaggccgtcactctgctgttttctttcctgaaaggcatgggcgctgatacggacgatatggaaagaaatacgcagcctcctgaagaccaaaagcagcaccagaaaccgcagacgaatgagtgaacatttctcccgagcctggctgaaggctcgggttttttgtgcgcttctgctgttttcttgggagaaatttcacctccggattcatgacttttgttgtgttatgttaatagttaaggttatgaatagaaaaaaattgaaaatatgtgctaggataaaattcaaggtacgtcaactattcaaatatgaaacaatcaggagtgatgtaacatgagtaagctgaggagcacgagacaagccatccaaagaaccctgatgaaaggaaaaaacggcctggacgtatacaacccttttccttggtatgaaaaaatgagacgtgaaagccctatatactttgatgaagaaacgaaggtttggagtgtgtttttatacgatgatgtcaaaaaagtcatcagtgataaagagacgttctcaagccgcatgactgatgtgaaaagctcgattgcaaagtccatgctgaatatggacccgccgaaacatacccaaatcagatctgccgtcaatcgcgctttcactccccgtgtcttgaaggaatgggagccgagaattaaagacattaccgatcatctcctgaaacaggcaaagaacaaagggcggattgatatcgttaaagatctctcttaccctttgccggtcatggtgatttcagaattattaggcgttccgtccgagcgtatggatcagtttaaaaaatggtcggacattctcgtcagcatgccgaaagatgcgagtcctgaagcggcggagaaaaatcagcaggaacgtgaccaatgtgaggcggagctggcggcgttttttgcgggaataatagaaagcaaacgaaaacagcccggccaagatattatttctattttgataaaagaggaagaagagggagagaagctcacgccagaagatctgatcccgttttgcaacctgcttttagtggcgggaaatgaaacaacgactaatctcatttcaaatgcggtttacagcatattagagacgcccggcctttatgaagagctgagacaggacccttctctcatcgcgcaaacagtggaagaaacgctgcgttttcgcgctcccgctccgtttgtcagaaggacggtccggcacgacactgaactgcgcgggcgccgcttgaaaagcggagagatcgttctctgctacgttgcatctgccaaccgtgatgaaaacaaatttgagaaggcgggcgtatttgatatccatcgccaatcgaatccgcacctttccttcggattcggcgtacacttctgcttaggcgctccgcttgccagacttgaagcggaagccgcactgaaaggaattgtaaaagccttttcacaccttgagcccgttcggattgagccgatccgaaacagtgtcatgtacgggctggagtctttagaagccgagataaacgaaaatgagggagaagaaaaaagatgagaaaaacacacatcgccattattaatgtggccgctcacggtcatgtcaatcccacgcttcctgtagccgaggaacttgtcaatcgcggatataaagtgacattcgctacgactgaggaatttgaagcttccgttgccaaaacgggtgccattcccgttttataccgcacaagcataaaggcggacccgaagacgataaaagaacgggtaaacaaaagtgacgcgtttgtgatgtttctggaagaagcggttgaagtgcttccgcagctggaagagctgtacaaagacgaccttcctgacatcgtcctgtttgattttttagcgcttgccggaaaattgtttgcggataatggcggcatcccggccgtaaagttctgcccgagttatgcaatgaatgagtattttcaattaggaagagacgaagaaacgatggaagcggccaaacaggcgatagaagaatatcaggagaaaattgaaaatgaacaagtgaaacggatgacaatggaagaatttttcatgcctgaaaaattgaatatcgtctttatgccaagggcctttcagccgaaacaggaaacctttgatgaacgattctgttttgcgggtccgtctcttggggaacgcacaaatacgggaagtctggaaattgatgcagccgatgaccgtccgcttatgctcatctcactgggaacggcgtttaacgcctggcctgaattttaccggatgtgtattgacgcgtttcgggactcgggctggcgggttattatgtcagtcggcacaacaattgatccggaaagtttttcggatgtgcccgatcactttatcatccgccagcacgttccgcagcttgatgtgctggagaaagcaaagctgttcgtatctcacggcgggatgaacagtacaatggaggcgatgaatgcgggtgttccgctcgttgtcgttccgcaaatgcacgaacaagaggtcaccgcaaagcgtgtggatgaattggggcttggcgtgcatctgccgctgaaagaagtcactgtggcccgtctgcaaaaagacgttcagaacgtatacggcgataaaaacattctcagccgcgtgaaaagcatgcagcagaaaataaaagaaaccggcggtccaaaacaggctgtttgcgccattgaagaatttttgaaaacggcgtccgtcgaaaattgattaggaaaacaggcagcaccggacggctgcctgttttgttatatgtttttcttcatgccgcatctccggcattccctcaaaaattttccgcccttcactgagcttttaaacagcgtgtagtcgcaattgtcacatcggccgctgtgaacatcaggatattcattgaactcataaatgaccgaagtatcgtatccttttgtctcgaactctttttttgtttccatgattgaaagtccctccgcgaatcaaatcgttctgtccggttaatgatacagcaactgcacgggggattcaacgggagcatagcttgattttcccgtctgattgcgtaacaataatagaaataaatgacggcctgccatagggcgcccggcatctgaagggaagaagaaaacagcgatgggaaaaggattgaacgggaaacggattgccatcggcggttcgcggaaaacagaagagatcacaaaattaatagaaaagcagggcggaacggcggtcatccgttccctccaaggaaccgtatacctggcggaggatcaaatggaacccgacgtaagaacatttgccgagcaaaaagccgactgggtgatattcaccacaggcatcggtacggaaacgttattgtcggtatcggaaaaaatcggtctgaaagaagaatttttagcggccattcatgaagcgaaaatcggctgcagaggctataaaacatatgcggccttaaaaaagctcggcatcacgccgcatgcctcagatgaagacggtacaacaagagggctgatccgctccttggaacgatttgactttaaagataaaaaagttatgatacagcttcatggcgaaaaagcgccggttttaacggagttccttgagaaaaacggagcggaggtattccctgttctgccgtatcagcatattccgcctgaaagggagacggtcgataaactgatgggagagctgttaaacggagaggtcgatgccgtatgttttacgacagccattcaagtgcgctctctctttgattatgcaaaagaaaaaggatccgcaaaagaattgcagcaggcattcgaaaaacatgtgcttgccgccgcagtcggcaaagtgacggctgaagcgatccgggatgaaggggtaaagagggtccttgctccggacattgagcggatgggagcgatgataattgaattatcccgttactatgaatctctgaccttgtcataaaccaccattcagcagggaaaaaagcttacgcttccctgctgaatttttttaattgccagtgttccgtgaaaagggaaggatatgtcaaggcgctgagtatgatgcatgtaagaagagcggaggccatcgttgtaaaaacgatcagcagctgaaagcgcaccgcctgtatcggatcagcccccgctaaaatctgccccgtcatcatgccgggaagctgaacgagacccaatgttttctggctttctagcgtcgggatcatactgagtttcatactggacgtcaatatctgccggacggcctgcttaggcgttcctccgagagagagaatcagctggatttcttctttccgcaggtctgcttccgaactgagccggcttaaaaacagacttgagagcaccatggagtttccgatgaccatgccgcttatcggaatgacatatcttgaagtgaacggaatgatgtgaagggtcagtaaaagtccctgcgtcacggtttccgcgattgccagtgtcagaaaaacgcgccaaaatgagccgatccgcatttttttccgtttggcgacattgtgcgaagcggccgtgagcatgagaagcaccattaatatgataaatatcgggtgatcaccgcgaaaaatcagcgacagcacatagccgatgatgagaagctgaatgacggccctgacggttgcgacgatcatatccttttcgacaccggctttaaaagatttagacaggaataaagcgataatgacaaatatacttgttagtaacagtgaaagatcattcatatcagcacccgctcccttgtaaaagcgcccgggctttttcgtgtttcggttccttaaagaacgttttcgtttccgcggtctctaaaagccgtccctcagccataaaccataccgtatcggataatcgttctgcttgttcaaggttatgggtgatccacaggattgtcagctgtttttgccgatggagtttcgtaatcagtttctcaatggtgagaacggatgaggagtcgagcgccgaggtgatttcatccagcagtaggatggacggcagtccggcgagagttcgcgctaatgagagtttctgccgctgacctccggataattctttcgcattccgatccagaagcccgcgcggaaggtctgtaaaatctgcgagctcttcaggggtatagtgctgcgccccgtggagtttttctgcgagcagaaggttgtcccgcaccgtgccctccgtgacgggagctgattgaaatgcaaggcccgcggtttttctgagctccctgatatcccagcgccttatttcttttccgaatacaagcacttccccttcatcaggtgtattcatcagattgcaaagtgacagcaatgtgctttttcccgcgccggaaggccctatcaacgccgtgatagaacctttttggatatgtccggttacacggcttaggacatcaaaggacgtattgttttgttcaaagcgtttgccggctgacagaaaagatattgccggaatttcttctttcatataggatgacacctttcgtaaaaaatcaggaaccggtgagattggctgacgtttgctccgccgttttctggtctgtctgccgggaagcgaatgtatgcatgaccattcccgcaataataatgaacagtccggcaaatgaaagaagtgacggaaacgccgcggataaaaagacgatttcgccgatcagtgcaaaaagaacctctccggactgcgtcgcttcaacagcagcgagcttctgcggctcattcctcaccatatcggtggcgcggaaaaataatactgttgcgataacgcccgagctgagtgcgacgataaaggattggaatgtctgtcccattgagggaagcccgtctctataccagccgaaagcggcgatcaaaagccaaaacggaaggcttgcgagcgtcatgccgagcacccgctgaaacgtatcgagttttccgccgtattgttccagcattttgcggttgccgagcggataggcaaacgccgcgacgacgaccggcgccacgctgaatagtatcgtgcggccggacagagaacccgcatgctgaagctgaatcagcccggctccgatcaggatgatgacggaagtaaccagcgaaatcagcgggatcttttgtctgacggaaaccgggcccgccggtgaattttttgtttcgcagaaaaacggcgacagaagcacacccgcgacaattgtaatctgccacgtgccggcgatcagccagccaggcccatatgccgccgcaaacgtaatcggggcataaaaaagcacgaacccggtaaaactccacttcagccaaaaaaacggttttttccggatttcatgccagagcggcgcccattttcctttcgcataaacgatcaaaaataaaaacggaatcataaaaagaaaacgcagggaagagctccacatccagcttccgccggaaagctccatcgccctgtttaaaataaatgtgactgcaaaaaacagagatgccaatattccgatcacgatggctttcattaaatccctcattttgacacatatttttttatactatactattcaccggcaggcttcgcaatggaatatgagaaaatagcgttttaataaatgatgaatgggaaacagacatatacggaggtgaacacaatgcagaaagaggatattcaagtgctttatttcgaaggtgacggccgcattccgaataacccgaatcttccgcttgttatttataaagcggtatttaatgaagaaacggtacagaaagcagagtccgtcctccgccggcacgattggtctaacagctggacgggcggagtatttccgtatcatcattttcacagcaccacgcacgaagttcttgtcgcggtaaaaggaaccgcggttttgaggttcggcggggaacaaggggcggacgccgttcttcaaacgggagacgcagcggtcattccggcaggcaccggacataaaaaactgtcgggcagttctgattttaccgtgatcggggcttatccgggcggccggcagtacgatacaaaaacggagaaaaatgatagaacttcagaagaaatcagccgtgtcccgctcccggaatgtgacccctttacgggaaaatcgggcccgcttttagaattgtgggaaaaatgacaggggaaaagcggacggtctgtaaaaaaatagcctaaaagaaacgttattacacccccgccatataaataatttcataaacgaaacaattcacgttcaaattttgttcaaaaagtgttattatataagagtaaatcaaattggggttttttatgtttgctattttcagagaggaaaaagaaattttgacttattcaattgtttttgttgatataaaaataatactggatatggcaaagtgaaaaactgggtagtaaacatttatttttgtaaatgattgtgcatgaattcacaatcttgctttttcatgcttttctgcatgaagggggaaaggctaccctttccaaaaaaaatcagcatactgcttatagtaaaggagaatcggatatgccagaaacaatcgatcaaacaaatgcatctgtcagccaaggccaacgcgatcttattgatcagctgctaaaacctgaagttcaagaatcactgactgttttagtggatcagcttccaaaactgactgagttagtaaatattttaacgaagtcttatgattttgcacagtctgtagcgacagacgaagtattgaagagcgatacagtgggtgcgcttacagaaattcttgagccggtgaaagaaacagcgaaagaagttgcggctactgccatcgaagcaaaagaccgcgcggatgcaagcaatgaaacgatcggacttttcggcctgctgcgcatgctgaaagatcctcaagctcaaaagctgttccgttttgctaacagctatcttgaaatcatgaacgaaaaacaaaaataatctcagattcaaattgatataaaggacggaggatatacgatgtcaaaacatattgtcattttaggcgctggttacggcggagttctttctgctttaaccgttcgcaaacattacagtaaagatgaagcacgcgtaaccgttgtgaacaaatacccgactcaccaaatcattacggaactgcaccgccttgcagccggcaacgtgtctgaacaggctgttgctatgccgctggaaaaacttctgaaaggaaaagacgttgacattaaaatcgcagaagtcaattctttctcagttgataagaaagaagttgccctttctgacggttctaagctgacttatgacgcgcttgttgtcggacttggttctgttacggcttatttcggcattcctggactcgaagaaaacagcatggtgctgaaatctgctgctgatgccaacaaagtatacaaacacgtggaagaccgtgtgcgtgaatactctaaaacgaaaaacgaagctgatgcaacgatccttatcggcggcggcggcttaacaggcgtcgagcttgtcggtgagcttgctgacatcatgccgaaccttacgaaaaaatacggcgtagacccgaaagaaatcaaactgaaattagtagaagcaggtccgaaaattcttcctgttcttcctgatgaccttatcgaacgcgcgacaaaaagtcttgaaaaacgcggcgttgagttcttaacaggtcttcctgttacaaatgttgaaggaaacgttattgatctgaaagacggttcaaaagtcgttgccaacacatttgtatggacaggcggcgtacaaggcaacccgttagtcggcgaatccggccttgaagtgaaccgcggccgtgcgacggttaacgatttcttacaatctacttctcacgaagatgtattcgttgtcggagacagcgctgtatactttgcgccggacggccgtccgtacccgccgacagcgcaaatcgcttggcagatgggtgaacttgtcggttacaacctgttcgcttacttagaaggaaaaacgcttgaaacattcaagcctgtaaactctggtacgcttgcaagcctcggacgtaaagacgcggttgccatcatcggagcgaactctactccgctgaaaggccttccggcatctttaatgaaagaagcaagtaacgtacgttatttaacacatatcaaaggattattcagcctcgcttactaatccttaagatcatacagaagacattgccggacttttctcggcaatgtcttttttttgcataaaaatgttaatagatacaattttctgaaaaataaaataaaaatgattgatatgtgagaaagaggaagctaaaataaaaaagaaccattttgttaacgttaacattttttaagagggaggatgagagtgtgaaagcttttatgggtgatgactttttactggatagtaaaacggccgtaatgctgtaccgggaatacgctgaaaacatgccgatcattgattatcactgtcacttaagcccaaaggaaatctatgaaaataaaaccttcacaaccattacggaggcatggctttacggtgatcactacaagtggcggatcatgagggccaacggcattgaagagcgctgcattaccggaaacgcttcagatgaagagaagtttttcgcctgggcaaaaacggtgccgatggcgataggcaatccgctgtacagctggacgcatttagagctgcagcgctggttcggcatttatgacgtattgaatgaaaaaacggccgcggcaatttggaaaaatacgaatgagctcctgcagggagacgggtttggcgcaagggatctcattctgaaatcaaatgtcaaagtcatttgcacaaccgatgatcctgccgatgcgctgacataccatgaaatgttgaaagaaagtgattttccggttcaagtgctgcccggatttcggcctgacaaaggtctggacatcagcagcccgggttttgccgattgggtccggtcgctggagagcgcttccggaatggctgtcaccacctaccaatcgtatttggatgcgttggaatcccgcgtccgcttttttcacaatgccgggggaagagtgtcggatcacgcattagatcaaatggtttatgccgagacgaccgaagaggaagcggcccggatttttgccgccggattaagcggagagcatgtgtcttttgaagatgaaaagaaattcaaaacacggacgctgcaatatctttgcggtctttacgccgaactggactgggcgatgcagttccatattaacgcgttaagaaataccaatacaaataagttcagcagcctcggtcctgatacgggatatgactcgattaatgatgaatgtatcgcaaaaccgcttgcccggctgttagattccgccgaaaaaaagtggcaattgcctaaaacgattttgtattctctgaatccgaatgacaactatattatcgccagcatgatcaacagctttcaggatgggaaaacaccggggaaaattcaattcggcacagcctggtggttcaatgacacgaaagatggaatgcttcaacaaatgaaagcgttatcaaacacaggcctgttcagccggtttatcgggatgctgacggattcaagaagtttcctgtcctatccccgccatgaatacttcaggcggcttgtctgcacgctgatcggcggctgggcggaacaaggcgaagcgccctgcgatatggagcttttagggaggattgtcgagggaatttgttaccggaatgctgaggaatatttccgcttttaaaaaatggaatgaaagaggtggcctatgagtaatgtgcctgtcgtgacagcacctgccgcaaaagtgaaggagcataagctgagtctgaaagaaaaagtatcctatggtttcggagattttgggaacggatttatgtttgatctcgggcagatctatttgctgaagtttttcacagatgtcgcaggcattccggcagcgttcgccggcagtatttttttggtcagcaagctgtttgcggctttgactgatccgattgtcggctcggccattgactacagaaaaaagatcggaccccgggggaaattcaggccgtacttattattcggaagtattattcttgcggtcatgaccgtattgatttttgtgtcaccggacgtgagtgtcacctggaagcttgtgtacgcctatgcttcttacatgctgtggggggtcgcttattctttcgtcaatattccgtacggctccctcggtgcagccattacacaggatgcggaggacagaacggcgctttccgcattccgccagatcggctctctcggcgcgctgctcattacaagtgtcatcgtcatcccgattctcgttcattttgataacgttcacatcggctacccggcagtcatgggaatgatggccgtaatcggaatcgcgggatttatgatctgctaccgaaactgcaaagaaagaattatcgtccgtgaagcgccgaaagaaaagctgtccgtcatgtcggttttcaaatgctttatcggcaacaaaccgcttctgactgtcgttttcatgacgattttctcaatatcggcatacaacattaaatccgctatgcttgtttacttcgcccaatacaatctcaacaatgcggagctgatgtcctacatgagttttatcatcatcggctcttcatttttaggtgtgttgtttatgccgaaactcgtcaaacgcttcggaaaaaagcaaacggtgatgatcggttttgccgtcagcgccgcggctgatgcgctgaatttctgtctcccgtcaaatgtatatatctttacggcgttagcgagcattgcttttatcgggatcagtataccaaacggcattacgtgggcgcttgtgtcggacattattgattacggagagtggaagacgggtgaacggaaggaggcgacgacatattcgcttttcaacttctccagaaaactcgcccaatctttatcaggttttctttcaggcatcgggctgagcgttatcggctatatcccgaatgcgtctcagacaaaaggcacgttaatcgggattaaagggcttctgctgctgtacccggctttcgctttagcgtgcgccatgctgattatcggtttaatgtataaactgacggaccggcagcatgacgagctcgttcaggacttacatcatgcaaaacctcaactttagtgattttatggactgtccgttaatggtacaatagaaataaatgacagcatacagaaagaaaggaaaaacgatggtaaccataaaagatatcgcaaaactcgccaacgtatcccacacaaccgtatcccgggcacttaacggcagcccctacattaaagagcatacaaaacagaaaatattagagctcgcttcacagctgaattacacaccgaatgtaaatgcaaaaagccttgccatgcaaaagtcccatacgatcggactgttttttacaagcatcacaaacggaacctcacacagctttttttccgataccatcaaaggtgtaaaccgcacaatcagtgaggaatacaatttgttcgtccgcgcgattgacgatctgaaaagctttgaaaccattacgcccatgagatatgacggaatcattttaatgagccaaagcgacagtgataattcatttatttatcatatccgcgagaaaaacatcccgctcgtcgtgctgaaccgggacattgatgaccggagcatcacgaatatcctgtcaaacgataaagaaggctccagacaggcggtcgactgcctgatcgcaaacggacacagagatatcgcgatcattgagggaaaggaaggattcaggtcagcttctcagcggaaagaaggctatttgacatctttaattgatcattctatcccgattaagcatgaatacagtgtaaaaggccgctatgatatggaaagcggcagtcaggcgatggaaaaacttttggcgcttcaatcaccgcctacggctgttttttgttcaaacgatgatatggcgatcggggcgatgaataccattttcgccaaaggcctgaacgttccggaagatatttccgttatcgggtttgatgacatcggcatttcccaatacatgacgccgaggctttcgacagtaaaacgcccggttgaaaaaatcagcatactcggcgcagagaaaattttggcgcttatcaccgacccggatacggcggcggaaaaaatatacgaaaacaccgaggtgatgataagagattcaattaaaaaactcacataacggcccgtctgattatccgggtttttgtacgggagaatgttaacgtgtgcataaatataaggaggcggacagcttgcggcagctgaataaaaagatgtgcggaaaatacattcaatatcctgaaaaagtccttcagttcggcgaaggcaactttttgcgggccttcgctgactggcagatcgatcaattgaatcaattgacggattttaacggaagcgttgtcgccgtacagccgagaggctctgagaaaataaaacgtttaaacgaacaggacggtttgtttacgctttttttgcgggggataaaggacggaaaaccggctgaagaacacacgatcgtcaaatccatcagccgcggcattgatcttttttctgactatgattcctttaaacggctggcagcacaagaggatcttcgttttatcatctccaatacgacagaagcgggaatcacgtttgagaaaggcgaccggcttgaggataggcctcaaaaaacattccccgggaaattagcggcgttcctttatttccgctataaggcatttgcgggtgacgccgagaaagggtgcattgtgcttccatgtgaactggtcgaagaaaacggacggaaactgaaggctgccgtgcttcaatatgccgggctgtgggagctggagcctgattttactcaatggattcatgatgcgaacatcttctgcaataccctcgtggatcggattgttccgggatttcctgttgataccgcggaagaacttaccgattttctcggatacgaagaccgtctgcttgtggtcggtgagcattattatttgtgggtgatagaagggccggaacagcttcagaatgagcttccttttgctgatgccgggctgaacgcactgatcacgtctgaccttacgccttacaggacaaaaaaggtgagaatcttaaacggcgctcatacggcattggcgccagtggctttattatacggactgctaaccgtccgggaagcggctgagcacgaggtgacgggcagattcatcgaagagctgatcaatgaagaaatccttcccgtgctgcaaatggagggtgtcacccagtatgcggcagatgtgttacaccggtttaaaaacccttatatccaacattatctgcaaagcatcacccttaacgccgccgcgaaattcaaaacaagaaacctgccgacgctgaaggcttatatcgaacaggagggccggcttcctgagaggctggtattttcattcagcgccatgatctattcatactggaacgggctgaacaaaccggcagatggcgaggaggttctgaaccgttttcaaatggcgcggtcccgttgcaaagatgatatgtttcaagcggcattttctatattaggagaagagcgattgtggggaaagaatctgaaccatcttccggggctgactgaacgaacggctttttttctctctgtcattcataagcgggggatgaagcatgcgttacatgaatgctgcggcaataaggggggaagtgaaatgaaagaggtcataaaaatccataaaaacgataacgtgcttctcgctatgcgccattttaacaaaggggagcggctgtatacagacggactggcgattgaagtgaaggaccctgtaaagcgggggcataaaatcgcgctgcaaaccattgaagaaaacggcagcatcattaaatacggtttttcaatcgggcgtgcgacaaggcggatttcggccggcgagcatattcatacccataatctgcaaacgaatttatccgatgtgcaagaatacacgtattcaccgcgcttcgaggacaatccttttacaaatgagaaccggacatttaaaggctacaaaagagaaaacggtacatccggcgtccggaatgaactgtggatcgtgcctacagtcggctgcgtaaacggcgtcgctgagaaaatcctgcagcgcttcgtaaaagaggcgaaagacattgccccctttgacaatgtgctggttttaaagcaccaatacggctgctcccagcttggcgatgatcatgagaatacgaaacaaatgctgattaacgccattcgccatccaaatgcgggcggtgtgctggttttagggctaggctgtgaaaataatgagctggcggcaattaaggaaacgctttctgaagtgaacggagatcgggtgaaatttctcgaatcacaggctgtcacagatgaaattgaagcggggacagcgcttcttaaagagatacaccttgcggcaaagggagataaacgtgaggagattcccctgtcagaattgagcatcggattgaaatgcggcgggtcggacggtttttccggcatcaccgcaaaccctttattaggaagattttcagattacttgattgcacagggagggagtacggtcttaacggaggtgcctgagatgttcggcgctgagacgattctcatgcagcgtgcggtgagtgaagaagtgtttcataaaacagtccgattgatcaatgatttcaagcaatattttatgaagcacgagcagccgatttatgaaaacccgtcaccagggaataaggaaggcggcatttcaacgctcgaagacaagtcgctcggctgcacccaaaaagccggtcttgcaccggtttctgatgtgctgacatacggtgaaacactgaaaacaaagggattgacactgctcagtgcgcccggcaatgatttaatcgcttcttcagcgctcgctgcggcgggctgtcacatcgtgttgtttacaaccggaagaggcacgccgttcggcacatttgtcccgactgtgaaagtatcaacaaataccgatttatttcaatcaaaacctcattggattgattacaatgcgggcagattggcggaagaccaaacaacagaagatcacattgtgagagattttattcaatacattattaaagttgcaagcggagaatacgtcaataacgaaaaaaacgattttcgggagcttgcaatctttaagtccggtgtgacgttataagggaaaaggcgatctgacaacagaccgccttttcgcattcacttatcgttttgccccttgatgaattgtgaatatctatgagctataataatggaatggtgccttacataaaggagatttttataatatatataattattatggaagattggtttttagtcacatatttcagagggggtcctaatgaataacattttatacattgaagatgaccaagaaattggccaatttgtaaaggatgatttagaagatcggggctatatgattatatggctcacttcttcctataattacgaaacatatatagaaaaggctgatctgatcgtgcttgatataatgatgcccggtttagatggatttacaatcggtcaaaggatgaaaaaaacacatccgcagatcccgctcttgcttttaacagcgagaacgggtctggaagataaactgaaaggcttaggatttgcggatgattacgtgacaaaaccctttcatcccgatgaactggccgctcgaatcgaagtattattaagaagatttgacaagactgccattcatgaattgaagctaaaacacttaagtgtccacttgaaagaaaaaagaattttaaatcatcaaagtcatgaggaaatatttttaactgataagcagttaaggatttttttgcttttgcttagacatcccaatcaaatattaacaaaggaacaaatttatgaaaatatttgggagcagccttatatcgaaggggataagacgttgatggtacatatcaggcatttacggcaaaaaatcgagatcaatccaaatgagccggaaattcttgaaacgatcagagggattggatacaggattaaacaatgaaattatcaacaaaataccttattaatatcgttgcctcaattttgttttttccgatagcctttttaggtgtgaattttctttactatgtcacattaacatacttgattgatcaccaggggcaagtacactatgaaccaaacaagttggaaagtgattggaagtctgatgtggaaggtttttcagggaaatccaatcgggaaattacgtctgctttcccgcacatgaagcaatataaacactctgatattgtatggataaatgataagggaaaggtgatgttttcgaactcagaacggttggccaaaaagggtgaggttattcacgttagcgaattgattaaattgatggaacaaaaccaaaagaaatatttattgctgagtgcttatgtaaatgggagtgaagacagcggatatgcatttttagaaactccgcgctcaattataggatctcaatgggaggttatgagggccaagtattcctatatatggtttatcgccttgatttttgtctgttcactttttgtgattaattcatggatgttttttgcgaaaatacaaaaaaggttaatttctttggggaatcatatgaaaaaacaagataatgacggcataccggaatttgtaacagttaaacagaaggatgaactgggtcaagtggaatattcattcaaccagatggttgaggaactaaggaacagcagacaaaaagagcgtgaagaaggcgaaatccgaaaaaacttgattgctgatttatctcatgatttaaggacccctcttacggttataagagggcatacatttacgttgaagaatgaaataagcagtgaaaatggaaagcattctttaggcatcataaacgataaaataacgtttatgggcgaactgattgacaatttgtcatcattttctcttcttgccgcaggtaaattgccgcttcataaaaagagttgtgacatattaaagataatacgttcttcgttaacagcttggtatccaatttttgagaaagagcacttcacaatagatattgatctgaaggaaaacatcgtatgggaaatagacgagacttggctgaagagaattcttgataacatttttcaaaatgttttgcgccatgctcattcaggaaaatacgtttccgtacagacaaagctaattgaaaacaaacccgtaatcataattgaggataggggcccgggaatgaattataaatctgaaagaaaaggcgccgggatcggcttatcgatcattaatatgatgcttaaacaaatggggcttgaacataaaataaagagcaatcaaaacggaacggtttttattatttatccaaacagcaatgaatacgtgaagccgtagaggcttcacgtattttttatattgagaaatttaaacgtaaattaaccttgactatatcttctttttaacctcgtaagtttatattataaacagaacaagacggagaggaatgatgaaaagtgggaaaggctgatccagctttaatatccaagggtatcaatgtttctataaaaaagaaagaaattttacatgatataaatttaacattggaaaaaggtaaaatatatggtttattaggtcccaacggtgcaggaaaaacgacattgcttaaagttctgttagggatatttcctccaacttcaggtgaagtgatttttgagggggatgacttatatggaaatccaaataatgatgtgattcagtctataggaagcattatagaatttcctggcttttatgaaaatttgaatctttttgagaatattaaattacatcttaactatttaaaaaaatcagcttctgatgaagaaataaatgagattttaggaaaggttggactttttgaacataaagataagctgttttcgcaaacttcattaggaatgaaacagaggctgggaattgccagagcagttgcgcatgctcctgcattgcttttgctggatgagccgacgaacggtttagatccatatggtattaaagaagtacgtgaaatgttgatccaagaggtaatgaaaaatggaaccacagtcgttatttcaagtcaccttttaagtgagattaatctcatggccgatgaattgcttattatgaataaggggcagattattttcgagtcagcctttatgaaaaatacgcaacatctttatttgtacaaaattccagctgaagcgggtattaattgggcggatattgagaaatttgcggatcatgttatttcaaagaataaacagcaattcgagtttatttcaataattcatccgtcggaaatgaaagagaaattaaattcttggggatttaacaaggcgtctattgacggatttaagctatctttggaagatctttatttaaaactgctggcaaaggagaaaggtcatgagtctgttagtgcgtaacgagtttctgaaacttaaaagactgaaatcaatttatgttattttctttctaagctttttgccatttctcataaacggaatcggtcttttgactatgaacgaaaatacagattggaacaaattttatatgtttgtttttaatcagtattcgatcctatttccgactattatttttattttttcaggtttttatttttatttagaatttaaaaacaggacaatgttgaattggatgtcatatccgtatcataaattcaaattgatattatcaaagctagctgcagcttttctatttttgtttttaatctcagctgttaatcatattattcacttatccaccttgtttttcttttttcgggaagatatctcagcaagcgacttattaagattaatagcgacatcttttacttctactactttgagcctgctaaccattccgattgcagctttaattgctttcttaagtaaaaatctagtggttgtcatgataaccggtgtagcttcctttttaataatgacgatactgttagcaagtgatgtctcaatagtctttcctttttcttttatttatcgtttcagtattcaaatttctgaaagtgatatgggatataccaattcaattcttttagtttggggattactgattatggggctgtatgttttggtatccttatcaggattatacgtatattcgaaaaaaaacagaatgtaaatggaggatgagtatacatggagcaagttatttttgtgatttcaatgctcgctttaggagttacactggttacctttttcggaatgattttgaatgacggattaagaggcgtactaaacttttcaagaaaacctgtaaaatttatgactggatcatttctggtatacattgttgcctttgctgtttatattttaataagtgtaaagtaactttttcattttaaggggattcaaagggattcccttattttccttagtaaggggcttggatacaaatgaaagataattgggtgaagcttaatattgagcagtttgcaagggcttttgttttctccttattattgttttttatgcttttgcttataacagacagccaattacagtttaaacagtatagtctattttttgttctaagtatattcggcagtagttgtttatgctttacctatgatgacagaaataagacatatcttcgcagcctgttccgtttttcagaattatgtcaaaagggatccgatgcagatcaattgataaaagaactaaccaatgaaatacagagtgtgctctcaggaaagcagattgctcttataaactatgacaaaaaaacattaaaattgagagaaaaaaacattcaagttcctaacataaacatttcaaattttaagataggagaaatacgtgaaaccgccagcggatcaattctgtttatcggggagaagtgtgatacatttgtttttattcatttatcacatgaaggacaccctataaagattcgtgaaaacgaggcagattggctgcgaatgctggcattctgcacagcatctgcacttcagaacaaattattgattcaaaaaaaaattgatgaaattatcatagacgatcaacataaatgtaagtcggctgtactttctaaggttttattttcaatttcagaaatagagagaaccaagcttgcacaggatattcatgactctatcattcaagagctgatatttgtatgcagagaattagagtatcatgttgagaaatacaaggatatttattacataagagaaattttgctggacaatatccagtatataagagaaaaatgttttgatttaagaccaccttttttaatggagatgggacttcttcgaagcattcaagtcctgattgataaacataaaagcaactatcagcttgatattgaattctttgtagatgtaaaagatgattctatttttacagaagatatcacaataaacatttaccggattgttcaagaactgcttactaatgctgtaaaacattcaaaagccagttatattgttttgacgatgattcaaaaaaaaacaagtcttatgtttgtttacgaagataatggaatcggcattgattggaataaagtaaattcaaaaacaaacagttttgggctgacagggataaaagagcggataaattgtatgaatggtattcataatatatcttcaagcgtaaatgaaggattgctgttaaggtttgaaataagtacgaaaaatgaatagggagcgctgacatgataaagattctattaattgatgatcatattggtgttgctcaagggacaaaagccattcttgaaaaaagcaataaaatgggagtaacaatattgtcttgctgtaaagaagtacttaatcaccttaagcattatgagtatgacttaattttacttgatttatatatgccggagttaaatggaatggaattgtcaaaaatgattcttagagagagccccgatcaaaaaattataatttatactggttttgatatctctgtgcatttcaatcttttggttgaagttggtgtttccgggttcataagtaagtcatcaacagaagaacatatgataaaagtaattgaaagtgtcattgagggagataccattattcctactcatctctttaaacaattaagaagaacagaagcaaatacgttcaacattgataagcttgaagatagaataagagatattactttaaatgaaagagaacaagatatcttagcgggcgtagcggagggaatgacaaaccgggaattatcagcaaagctgttgatcagtcaaagagcggttgaatacattcttactggtgtgtacaacaagctcggagtaaaatccagaacagaggcactgatcaaagcaaatcgatattcattaatttctatgaaaactatatatgagtaaatgaatcgggattaacggaacagttaatcccgattttctttataacctatacttcggaaacgcgcaaaaaaaaagcgcttttccgaatatgacttttcggtgcctataggtaaaagatcgtttatcataggtttatagaaatatatggatcaaaatccaatatatttcaaaaatcaaggggaggaatattaatgaatgagaaaatgtatcgttttgccggtgatttaagagaagaacttgaggaaatttctttaagtgaattcagcggaggaggaggcgcagaacagcgagggatttctcaaggaaatgatggtaagctttgtacgttaacttgggaatgcggtctttgtcctactcacacttgctggtgttaaaacaacccgaaataagaaaatagatttccaatgctctgggagatccagctgtctccctctttttttaaaggagatgaatattaaatgaattcgctaactaatattctattaagtaaagaaaaaaaagctgctgtctctcaatttgatgaaaatgagaaactgtttgatcgaaacttagaactaatctataagaatgatattcaaatggcccaggaaagcatttataatgtgttatccattcaatcaattgataaagtgaaaagcttatatcaaaccccactacataaatccgcttttacagttcatgttttcgaaaacctaaaaaaagggatcgctcaccaagctattaaaaaagaagacgtaaatgaagaaatcatgtttcacgtttttgcgttaaaagtgtcctcttacttcaatgatctacttaaaaaatcaaagtttccttcttatgactatctgctggaacaaccggctctttttcatcatagtatttcaaatcaattagaaaaaatcattttaaaagtatcctatagaacacttgtattggatatgaatatgaatcgggaaaaaggttttttggcaggggagactcctaaagaaaaatatggtgattataataaaactcttttgtgcagtcaggagtatcttgaaaactttttccaacgatatccagtcttattaagagcgattggaaatgaactgagaaaattcaaaaaattcatactggaatttatctcccgttttgaaaaggacaagcctgaactgctctctttatttggtttttcagaacaagtcaaaataagggacattgaagtagggatgggtgattctcattctgatgggagaaaggttactaaaataacattaaatgaaggtaaacttatttataagccgagaagtttagaaattgatctattatataaaaagataattgaatttttgaatgagaaaattagagatcatgatataaaattgagcactccgaatgtccttagcagagacggatatggatggactgaatttatatcttttaaagcatgcaattgtttaaaagatgttcaaaacttttatcagcgtacaggagctcaaatcggtttgttatatgcattgaaagctgttgattttcattcggaaaatctcattgccaacggcagctatccagttctcattgatttggaatccttatttcatcctgcataccagaaaaaaaaggatgggatggacgcttatgaaaaagctgaaacgcagcttcatgaatctgtcagagcattagggctgcttccttttttctttgcgggcaaagccgacatcagcggaataggtcggaaagggaaagcaaagtcgatcattaaagttcctcagcttatcaatttaaagacagcagaaatgtctgtcaaacgagactatgtcgaaattgatacagctaataatcaccctatgcttgagaataaatttgtatatgcaaaagattatgtcgaagaactgaagcaaggtttttcaaaagcatatatgactatattaaaacatgcttcggagctgattcgcataatagaaaagagcgaaaacaagatatatgttcggtttatatcaaaaccgacaataaagtattctgctttattagaattaagttttcatcctagatttttacacaactctattgatagagaaattttcttatcaaaaatatgggagagaccaaagcaagaagatgaatatcaatctattgttaaatatgagttcaacgatttaattaataatgatataccttatttcaaagtgaaattgaatgagaaagacttactaagctcaaaaaataagaaaattgaaaattactttccggaaacaccagctcaaagtgtaaaagaaagaatttcaaatttatcaaaagacgatttaaagtttcagctctatgttatcgaactgtcaatgcttgcttcggaggatgatcggcaaattgttttgaaagaatttataacaaaagaaccaggacaatatgtaaatgttttcagtagtaaccaagaaagtatcttaatagaaaaagcagaggaattggccgcttatatttataatcaatcttacaaagcacacacagataaaggaagttcgtattcttggcttaacgctactcctattggagttgatgaaattcaatggaacttatccgttatgggtgataccttttacgacgggctttccgggatggctttcacctacctggctttatggcgcgtcacgaaaaaagaaaagtatctggacattgccgaaaaaattatgaaagatgtcatctctcgttttattgatattgaggtgaaaccggacgaagacagcagtatgtctgtaggtgctttttccggagtgtcttcaatagtatatactttaatgaatttctatatgtatactaaacgcgaaaaatataaacagaatgcaaaacaaatcgctcagcttattccgtccttgcttccttatgataaagaattggatataatcgggggcacagcaggggctcttattgtaatgatacgttcgtttgaaatagagaatgatacattctttttatcattggctgaacaatgcggttcatttttaatgaaacaagcgatctttcttgatgaggattttgtcacttgggaaggtattgcaaataagccgttaacgggtttttcccatggaaacgctggaatgatatatgcccttcaattactcgagaaacattcaaaacatcaagatataagtatgtacatccgaaaaggacttgcttttgaaaattcaaaaaaagtaaacggtaactggcttgatctgagaaaaacggtaaatgaagctgcaacatctgcatggtgccatggatcccctggaattctattaagcagattagaattgaaagattcaaaacaccctgatattgccgaagtggccaaaaaagatctgaataaaaccgtttctaacattttttatgacggttttggccgagagcaaagtctttgtcacggagacatgggaaatgctttaatactgatcgaatatggaaaaaagactggtgaaagtcaatttgtaaatataggaaaaaacttgattttggagagtgtacaagacaaaaatataggtttctaccaatgcggagttggaagggatgttgaaacacctaatttaatgcttggtttagcggggatcgtatatggaatgctgtatgcagcagacgcagaattgccgaatattctcaatcttgaaataggacgtgtagatacattaggagacatttatgaaaattagaaaaagaaagcttccggttattcttcaaagaaatcaatttgattgcggtattacttgtttagccatggttttgagcagggctgagggaataaaaatcaatcctaacaaattgaaattaaataaagaaattatcggaagagacggcactgatttaatagaaatgaaaaggatttctgaaacattcgattatgatttcaaagcattccgcacagacaatataacgcagcttaaagagttaaataaaaaccatccgctaattgttcattggaatcataatcattttgtagttgtcgacgcatttggcacagataacgttaaaattatagacccttcgtctggcagactgacaatcacattagaagagttcaaaaccttctataatggcatttctattatgttaatcagaaagaacgaacttgagagaaaggataagactgcttcgtcgttaaaagatgtgtcttcatttagaaagatcggaaaatatcttttgaaagataaaaaattgttgggggttattataagtttcacttttatttttcaagcattaaacttaatgaccccttttttgactcaatatattattgattcatttattgacggaaatgagaaaattcttcccataccaatgcttttcatgattgtaattgtttcaatcgtattattctttagtctgtccttaatcagaatgaaatttattatcaaactgcaattaaaaattaataagagtatgactgataaaataattcataaaatatttagtcttccattaaagttttttgaggcgaatactgccggggatatttcaactagaatccataacattgctgtaattcgtgaagtcatttccaggttagcgtctactttgatattagatatcagtcttatatttgtatttttcatagtcatgtttgtttattctccgatattatcttttatagttttattgggagcagctatacaggtgatgagtactaaaattttgcttccgaaaattgaaatgttcacaaaacaggaagtaaatagtcaatccaattttcagagccagctaatcgaaatcttaagatcaatgacatttataaaaacaataggagaaaccaggaatattgagagccaattaaattataactttaatcatcagttagattatttctctaaaagaatgaattattcatctttactgggtgcggtctccaatgcaatcaatctatctttgccattacttattttaattgtgggtacttggtcagcagtatctataggccttacgctaggcgcagtaattgctttttctaacattgccggacggtttatgtctccgctgggatcaattatcggcagtttagagtctattaaattagttgaagaaatggtagacagggttgaggctgtactggatgaaaaagatgaggaagtaaatgataaaagcattgaactatttaacccggccgctcataatatcagcttgaaaaatattgatttcagctacaacggaaacgattatattttgaataatataaatttaatgatccggccgagagaaaaaatcacattaattggaaaaactggaagcggaaagtctactttgattaaaatcattgccggcctttatcaaaaaacagcaggagaaatttgctacggtgaattcaaaatcgaggacgttaatatggttaagctgagagaaacgttaggttatattgttcaagatgtcaatctgtttaatgacactattataaataatataaaatatttcaatgaaaaaataacaatggaagaagttgtacaagctgcaaaagaagcatgtattcatgaggatattataaaaatgcctatggggtatcataccatgattggagaaaatggtattaccttatcaggtggacagcggcagagaatctcaatagccagagtattagcgaaaaatccgcgaattctatttatagatgaaggaacaagcaatttggataaggatacagaattaaatatattaaataacatttacaaaaaggatatcactgtaatttctattactcatagaaccgaatggctcgaattctccgaatctgtctacgagattgaaaatggaaacttaaagacgattaagaccaaatatgaatcacagctccagcagacttattaacttgaaaggaggtgaaatatggaatatgaaagagaacttcagcgcgttgtatgaaacatcagagcaagaattaagagagcttattggagggcaaaactcagtatcaataacaacaattccaataacaaatcatgtttgtccaactatcacagtaggctgcgcatgtccgcaaaggcaagtataaaaaacaatcggggggatttttaatgaaaaaagaatttttagcattggaactaatgactgaggaagaattaaaagaattggcgggggctcggaggcaactccaatgactgtaacaccgacaaccatcacaataccaatctctttagcaggctgtccgacaactaaatgtgcgtctattgtcagtccatgtaacgactgaaatttataaaaaactcaaacaataggaggaattaacatgaaaaaagattttcaagcactgactccaatgactgaagaagaattaaaaaaccttgcagggggttcagatgcaaccccgatgaccgtaacgccgacaaccatcacaataccaatctctttagcaggctgtccgacgacaaagtgtgcgtccattgtcagtccatgtaacgattaaacatatccgaaaaagaatatgtatatgcgtacatattctttttcttttttgtcaaagacagtcaagaatatataaggaagtgataattgtgaacaaaacacagaattcggctaactatgtttatgaaaactctatgttgaatatttttaaagaagaggattatttcgaaggttttgcgcagtattatataagtatttttaaagctcagattgttaaagaaatagatagaataccatccgaaagtctgttggataagggatgtcttgttgaatcgatattaattaattataagaaaaaaatatactatttggcggggaaaacacttatccatgagtttcatcaaacttttgacgagtttgatgaaaaaaatgaatctaaaaattatgatatattctcagaaaggctgaaaaactccgcatttgttgaagaaatactcaataattatcctgtattgcaagatttaatctccagatccacctctgattttatacgcttcactatatctattattaaacattgggttaatgactataaaaaaatccaacaaaaattcaacttttcgttcggaaaaatgagaaaggttaatatgaatgcaggggatgttcataatggcggtaaaagtgttgttattattgaatttgagaataacaaactcgtttataaaccccgttcacttgaaattgatgttttttatgaaaaggtcattgattatgtcaatcagtattatcaaactaatttaaaaacacctttatccttggatcaaggtgagtacgggtggcaagagtatgtacagtctgaaccgtgcgataatattgaacaggtaagaaattattattaccaatttggaatgcatttaggatttatttatgcttttcaagggtcagattttcattttgaaaatatcatagcatgtcgtgataaaccagtgttggttgatcttgagactctgtttcaaagcagcctctttttttctgaggagaacaaggaaaatgttaatttaatggcatcagcacaggtaaataaaacaatattaaaatctgcactttttaactatatgagttttccggaagataatgggctgactaatataggaggcttgataaacacagaaaatcaaaaaggtgaaaaagaagaagtgcttcatataaaaacagataaaatttctataagaaagaaacaatatctcttcaaaaggggaaggaatcttcctgtttacaaaaataaagtagcagaatgttttgaatttgaaagagaatttattgaaggcttcaaaagaatattcttgattttgaaagaagatttatatatacggaaccttataagcgaattaaattatgcccctattagaattattgtcagacctacatatgtttacgcttcatttcttgaaaccctcctccatcctatgtatttaaaagattatggagaaaggataagggttttatcttttattaaggatgcttatacaaaatatgaagtatttgattccatcagtccatttgagatcaaggatatgatgatcggtgatataccctattttaatgctcctattagtgaaaaaagggtttattcaaattcaatacatgtggtggatacagggattatgaaacaaagcgctaaacaagaagttttaactcgtttagcgaatatgtcggaagaagacatgcatcagcaagtgagcttgataaatatggccttaagctccacggcggctaatttggatattatttataaaaatcaaattgatgattttgtacctggatatttaaaaaatgacatacaaatcaaagagctgattcaaatagaaacagattgtatattaaaacaagcaatcgaatcggagaaatatcttcaatgggtatcaatagtctcggctcccaatggcaccttatccgtaggaccgttgagttttgggctgtacgatgggttagctggagtggggctttatttttcagcttatgattttatttataatgatgaaaaagtcaaatcgattcttcgtaaaatagtgaattcaattaatcaaatatatgagcatagtatttataaaacaaatttctctgctttttacgggtcaagttcttatatctattttgtcaataaaatgagaggtaccggactttattcggaaaatgaagtgaatagtatgtgtaaagcatacttagagaaacttcgtcaggaaaccgctcaaataacacataccgattttataggcggactcgcaggtatattaaaggttgtgattcagcttggcaggtattatcggactgaattaatggaagatacggcaagggcagtttgtaaagaaatatgcaaaagaatgattcaaaatagaaatgaagcatattggaaatccgacgcggatgagaatgttgttttagcagggttttctcacggtattactgggatttgttatgcactatctgaatattatgcgcatattgaggcatctggagaagtacttagactgattgaatcagctctcaaatacgaagataaattttttgatactaaaataaaaaaatggagggataacagaaaaaatgagtcggattattcttccgcaatgtggtgtcacgggtcttgcggtattcttcttggaagaagcaggatatacgagaatgtagacgggcgcattcacgttgggtatattaatgagtctttagatgacacattgctgaatggaaattcccatcgtcagggctactcattatgccatggaacgatggggaatatagatgtacttcacgctattaaggaattatctctctttaaaaatcgcaagcaagagattgagaatacaattaatatatgggttaaccattttaaagagaccctgttgaaaaatggctggcaaaatggaataagaaatgatcattcgggacttggtatgatgttagggaaaaccggacaattatatgcacttttaaggttagttaataaagaaattcccaccccattggctttggattgagggggatttcccaaataaaaaagcgatcctgtaaaggacgctttttttagattaattttatcccgctgattaaaataatcgccgccatcacaaactgcagcgggcgcggtgagaatttcggcgaaaagaagctgccgagaagcacacccggcacagagccgatcaacagattcaatacaagcaggtaatcgacgcttccgaagcttgcgtttaacagaccggcaacagttacgagcaaaaaggcatgtgcgatatccgttcccaccacttctgctgttttcattctgaacaggtataacatggcgatcgcaaataatgagccggacccaatagatgtcaggccgacgatgaagccgaaaatgacgccgatcagtatcatgagtgtccgcttttcttcaagtgttttttgctgccagcggttcggccgcagttttttatcgaaaaaaaggcgggcgataatggaaatggcgacaagggtcagcacgtagccgagcgcctgtttgataatctgctcctgatgctggtgaaaagcgggaaacaagtgaagaataccgatggcggctgttgcgctgggaatgctcccgagcgccaagtagccgacaagtttaaattgaacggtgcgctgcttccaatgagaaacgacaccgaacagtttggtgatggaattatataaaaggtcagtgccgacggcgattgaggggttgatccccaaaacgatcagtaaaggagtcaaaagcgccgctccccccacacccgtcaatccgaccagcgttccgacaaagaaacccataaacacaatgcttacagtcatctgtgtgcctcctgaataatcctactatttttatcagattatatatgattaagaggcggtaatcaattaaattttcggaaaattttatacagaacaaaaaatccgcctgcctgctgttatttcgcagatcggcggatgatggccggattatgatttttgctgataaaacggaagttccgtgtggcccatttctctgacatacacgaaaagattgcctttatgatgaatttcatgctccatggcaagctgaaggagagccgcgccggttatttttctgccgaaagaggcagtcaggtcaatttcgcggttcagctgctcttcagtcagctgtgacaggatgtctgtcgttttttcagtacatgcttcagccagtttgacgaggtctgtttccgcttcttctttcggtttgttctggatagctgacccgtttccgtcgttaatgacgtttgcaaacataagaaaagaataaacgatgtgttttacaagttcctgagcggacattgatgtctccgccggcttgtagtcgtaatgctcgcggctgattttttccgccagctcaatcgtcacgtttcgatgtgacagaaagtggctgaccaattgattttgtgctgtcatgtgaaaacccccatttaatacagaataaaagctgcaaggatatgctatatcaacggcacggaagaaacaagcaataagcttgtgatggagataaatcgttgcggatatccgaaattcgacaattgcggtctttttgcgttcttctttttctagcaattatgataaaatatgacatatctcggtcattccaaaagggggatttattgaggatgaagcagactattccgtcctcttttgtcgggctcaaaattaatgaatggtatacccatatccggcagtttcacgtccttgaggcggagcgcgtcaaacgtgaagtagagagagagattgaggatatggaagaagatcaggatctgctgctgtattattcattaatggaattcagacaccgcgtcatgctggattacatcaagcccttaaaggaggacccttctcagcctgagttttcagaattattggaagacattgaaggcaaccagtataaactgacaggactgcttgattactactttaatttttttcgaggaatgtacgaatttaaacagaaaatgttcctaaacgccatgatgtattacaaacgggctgaaaaaaccttgcactcgtttctgatgacatcgagaaagctgagtttgcttttaaaatggccgagattttttacaacctgaaacaaacctacgtctccatgagttatgccgttcaagcccttgaaacgtaccaatcgtatgagacgtacaacgtccgcagaatccaatgtgaattcgttattgcagggaattatgatgacatgcagtatccagaaagagcattgccccacttagaacttgctttagatcttgcaaaacaagaaggcaatccccgtcttatcagttcagccttatataatctcggaaactgttacgaaaaaatgggagacctctctaaagcagccgaatattttgagacatccgtttccatttgcaggtcagaaaagttcgataatcttccgcattctatttactcattaacacaggttctttataaacagaacactacagccgaagcagagaagcaatatcgcctcgggctcagtatcgcccgcgaatacaatgatgaattgtttgtcaatctgttccaatttttgcatgcgttatacggcaaggaaatggataacgcatccgtcaggcacacgtttgattttctggaagaacacatgttgtatccgtatgtggaagaattggcgcatgacgctgccaaattttacatgaaacacggacagcctgaaaaagcgctcacgttttatgaaaaaatggtgcacgcccaaaaacaaatccagagaggagattgtctatatgaaatctaaactgttgtcaggattgctgcttgttgctgtcgggttcagctttacacaggtgatcggccatgaaagccatttggaaaaccaagcggacggcacattccatattgccgcacgcaaccaaacataacataaagacccttctttggaagggtcttattttttgcatgcgtgtccattccaattttatccgaatgcagggtcgatatgctcaagttatctgtcctacgaatgccacctattgatgaaaaaggcataaggagagatgaagagtggggattgaagtgaaaaaacggctcgtatcggctgataaatatgcgttaaaatgtccgaatccgatgacgccggagtatattaccattcataacacggcaaacgacgcatccgccgctaatgaaatcagctatatgacgggaaacagcgaatcaacgagctatcattttgcggttgatgacaaagaagtgatccagggaattccgttggaccggaatgcctggcattcgggagacggcacgaacggtaccggaaaccgcaagtcgattgctatagaaatctgttacagcaagtcaggcggcgaacggtacagagccgcagaagaactggcgattgcgtttgcggcgcagcttttgaaagaacggggctgggggattgacagaatcagaaagcatcaggactggaacggaaagtactgcccgcaccgcattttgtctgaaggccgctgggatgaagtgaaggcgaagattgaaaagaaattaagcggaagtatgccggcgaaaaaagcctctatttcttcttccgcgtctgaataccatgtgaaaaaaggcgacaccttatcggaaatcgccgcatcgcacggtgtcagcgtaaaatcgctgcaaagcatcaaccatatcaccgatccgaatcacattacagtcggacaagtgatcaagctcgctcagacgggttcttcttcaaaaagtcaggctgtgtcttcatatccgcttccatccggtgtgatcaaagtgacgaaaccgctgacgaaagggacaaacgtaaaacaagtgcaaaacgctttatccgcactttatttttatcccgataaaggagcaaaaaatcatggggcggacggcgtttacggcccgaaaacggcaaatgccgtaaaacgttttcaatccgtcagcggattaacggcagacggaatttacggcccgaaaacgaaggcgaaaattgaagaaaaactgtaatcaagaaaacggaagctccccgggcttccgtttcttcttacatacaaactgcggcaagggccttttgaatatcataaatgctttcatcttttttaaactgctttgagacagcgggaagttccgcgcctgaaatccaaattttcagctctgaatcaaggtcaaagcggccggcggtttctacgctgaatctggaaatgctcttgtacggaatggattgaatctccgttttcttccccgtgagtccctgtttatcaacaagaataagacgcttatccgtaaagacaatgatatctcggacaagcttaaatgcggcattgacattctcgccttccagcaaaatacgggccagttctgattttgcttcagccgtcgatattgtcgacgcattgcccagcaatccgttgatgaaccccatgatatctcctccctgatacgtattctatcaaatcatactataaaaaggtttccattcccagatgagtagagtaaactggtgctgactggaaaaggagagcatgttacacatgaaagatagatatgacaatttcgcagccctttccgctgctgaatcggaatacagaattatttatgaagaaaaagagggaagtaaatgtatcgtcctcgctccccacggcggcaggattgagccgggtgtcagtgagctggtgcatgcattttctgaccaaagctcaatttatttatttgaagggacgaagcggtgcgataaccgttctctccacttgacaagcacacgctttgacgagcctctggctttagaaaaagtgaccgcccatcattacgcattggcttttcacgggtatcatgatctgaaaaaggcaaatacactcgtcgggggcgcggatctggaaaaagcaagactgatttgtgatctgctgcgtgaagcgggatttgatgccgagctgacagagaagaatgatcggctggcagggttaaatcccggcaacattgtcaatcggacaaaaaggaaaatggggctgcaattggaagtgagcacggcgcagagacacgcgctgttcagcaattttggctgccggggagaaaaatacacgccaaccgatctgttttttcggtatgtagaaaccgtgaaggccggtttttatgataaatgaacagggggcccgttcttacattcactggagctatgcggcgcatgaagtgcttggcgggcagcacggtgattacagcgtcatgatgcaaaaaccttttctccgatgtcaaaatgatgacattctgccggctgtgttctaagccggcggagaatcgctaattttcaataaaatacggcgttttttcttcagcggcatgcaagtgtgtctgtccgcttccataatacacattcggccgcttgtcggataacagacaagcgagccgcttctgaaattgaatacctgctttacgccgttcaaacagctcgagccttttttccgcaaatgatgccgtcacccggaaagcggctgcgattaaaataacggcgtggctcctccgctggggcagctccatgtttaacagcataaaggtcggcacacagaagtggtacataaaatggttggcctgaaattcctgcagttccctgaacagcttgttcatatgaaaatggttcccggtatgcttcagcacatggcacagttcgtgcgcaaaatcctgccattgctcttcgggtgactttttttgattcaggacgatgctgtacatgccgtcccgcttcagcatcatactgtgcgtatcttcaaaatgaatccaaatgtcaagctccttggcaatcatctgcatatcaatatggagaggggcggtcattcccatgcggcaatataagtttttgacgtattcctcaagatgtgttaaaaaatcgcccaattgaatacaccctttcgaacatatgttcttttttaagcgagaaagaaaagccctgatcggactttgaatcaattcccttttcttttaaaaataaacattcagcttttatatcggctgaacgttaagcagtttaaaggaaaagagcggattatttatgtttcggcctgcggtttttctctttttcttttaaataattaatgaattcaatggcctgctgcttgctttccggggaaaagtcctgcatgtcccgatatgcgatctgcaggtcgggatcggcaaacatgtcttcatctgaaggttcttttccggttaacaaataatcagtcgacactttgaaataatccgcaagcttttgcagcgtgtcgtaatcgggttcagatcggccgttttcataatgagaatatctggcgcgcgagacaccgatatgatttgcgacttcttcctgcgttttcttacctctgagactctttaatcttccgcctatcatccgaaatgacctctcttttttcaacaccctaagttacttatgattatagatacaaaatgtatcaaaagaaagagatgataaaaaagtatcaaaaaggtcttgatgatacgaaatgtatcgtatataatcaacatcatagggatacaaaatgtatcaaaatacgataagaaattgatcaggagggtgagagatgcagccgataatcatccgtttcagcagcaatccggctgaccagagatgtttaggaaaagcaggcggttcgatatcttttaccgcttgcggactaccggtattccgatttgataaccgattgcagtatgaacgctatataggtctgaagaaaaatggagatgtcccttatgaaacgtaaaagctacccgtttttcatctattctggattattgaattcagaacattatgacaaaatagggtccgccatttggctgtttttatggttcatcagctcaacgacaaaggaacatgtaaaagacggcgtaaagtgggggatcgtcctcggacataagcccgtaaaagcaagagaaatggccgatgtattcgcggtcagcgaaaaaaccgtcaggcggtggctcgagagcttggaacagcatgagtatatcaaaaccgtccgcgccccttacggactcatcgtctccgtaaagcactcgaaaagattcacgccgaaaaagacattaacccgcccggaagcaactgaccggacaatatcggcggatcaccgggacaaaaatgtccggagagaaatagatataacaaaaatcatactgctgaagaagcgattaacgacattgctgcccattttatcagattaaggtctgcacaggaggggcggagcgtatacccgtcgccccgggattatcaggccatcgcccgtattgtttccctcggtgcgtcagcacaagaagcaatcaaatggctcggcgaatgctttaccgcttttgaacagcggcgcacctcttcagctgaaacgatcaaggctttcagctattgcgccaagtttatggaagaccgcttgaatgcacgaattgcgggaaggacaatcacaacaaaaaaagagaggaatacgatacatgacaaaacgaacgatcgagcagattcttgccgacctgaaaaacggaaaacgtccattactggcggacagaccggaagaatcagacaaaagccgctttgactgcccgctctgtaaagatcagggcggttatctcaaaaaccagctgggaatggaagtatgggttaagtgccgctgcgccgccgaacggaaagtagaacgcattctcggcgcaagtgagattacagatgcctttcggaagctggatttcaaaggatttatcacgcggggcaagcctcaggcagtcgtcgacgcatatgagtgcgcccttgaatatgttgagaacttcgacaagatgaaaaactgccggaaaaacagcattgcccttttagggcgtccgggatcgggaaaaacccatcttttgaccgctctcagcaattatgtcatgagacagaagcagacaccggtgctgtattttccttttgtggagggctttacggatttaaaaaatgattttgatctgctcgatgcaaagcttggccgtatgaaacaggcggatgtgctttttattgacgatctgttcaaaccgctgaacggaaaaccccgggcgaccgattggcagattgaacaaatgtacgccgtcgtgaattaccgctatttaaatcataagccggttcttatctcgagcgagctggcctgtgacggattggtgcaggttgatgaagccttgggcacaagaatttatgagatgtgcagcgattatttagtcatcattaatggcaattcatttgacgtaaaccacagattagagggggcgagataatgtgtaagctgtgcgggccgaagaaggtcattgtgatggaaacgggtttcggcgctgtctttcacccttgcccgaactgcaaaacaggcactgatttaacgccggtcattaaacggcttgaacgaatggttcaagacgcaaaagcgaggcttgatgcacgtgtgtaaatatatcaaatggcttttttgcctgctgttcagggcaaaacggatagaaaagcaaattgaagcatggcatgaggctgatggaaagtgaggatcaccattgcaagaaaaaaacagccccgctccatggcgggccgtacacagcggagaagaaaaacccatttacatttattccgcttacagcgaagcggataaagagaagttcccttattcaaacggaaggctcatcgcggccgttttcaacttaagttcatactcacagcagatcaacgcggcattgatggcgaaagccccggaactctttgaggcggccgaaacggctctccgcctgctccggggagaaagttctgaagaaaaagaagcgttcataaatgagctcggaagcctcatacatgaagtgaacattttgaaaaagatggaggaagtaaaacatgaatcctaaaaaactgactgacattgaacatacaacattaaaaagccagctggaagaaggcaaggttcgggtgattatagtagacggactgaagaaggaagcatggctcgccgaagcgccggagcacggcaaaacgcttgtcgaaacgcgaaaaggggatctggcccgggtcgaatatgaaatcggctttaaattgaattaatcgaaaaaaacagaatacgtccaagacggaaagcctgcggacactgatcaatcgcgcacatgctgcgcattgattggtgtccttttttgttccgaaaaagaggaggatctacatggaagacttactatttgaatataaacgcacgctgaaagagacgaaaaagtggtacaagcagctggaggcagcggatgaaacggtgtttacttcagaagaactgaaagataaaaaaatcatcagaacgattattacagatttggaatatgtcatcgaatggcttgaaaaaggccggcagcccggcataagaagagcgatagaccgcagagacgcttatcagagaatgctcattaaagatccgagaatcatagaaacctattcgcaggcgctgatgtttgaaccgtccgcaaatgtgactgaagaagacagaatcagactgcgggacgcattagccgttttaacggatagagaaaaagaaatgctgctgctccacaaagcggaatgcttttcgtatgaacggatcgccgccttgctgaatgtaaagaaatcaaccgtacaaacgacggtcaaacgggcgcttctgaaaattcaaaaacagcaggaacaaagaaatcaatcgcctgcttcataagttgtcatacgtttgccacctagaagtgaacagacgatcacaaaaagcggcccgattagaagccgctttttattatagacaatcatgtcggaggtggcggtgatgccgtagcatgaaaaacgcaaaaagagaacaggcatttacaatctatcagtctcataaaggccgcatcacaaatcgcgcccttgccggcaaatcaggcgtatccgcaagaacaatcggcagatggaaaaaagaagggcgctgggacgaggcgcttaaaaagaacgcggaaagcggcggaaaaaacaacccgggcgaaggtgatgagttaaacgaacgccagcggctgttttgtctttattatgtgaaatgctttaacgccacccaatctgcgataaaagccgggtattcaccggaaagcgcgcatgtgacgggaagcaggctgttaaaaaacgaaaaagtcgctaaagaaatcagccgcatgaaaaaggaaatggtcaataaagtgtttgtcgaagcgatggacgttcttcaagtctatgtgaaaatcgctttcgctgacattaccgattatgtaaccttcggaaaaaaagaggttcaggccttcggaaaatcagggccgctctttgacgagaatgataatccgattatgcaggagatcagctacgttgacgttaaagattcgcaccttctggacggaaccatcgtcacggaagcaaaactcgggaaagaaggcattgcaataaagcttgcggacaagatgaaggctcttgaaaagctgtccttgtactttgaccttttccctgaccaatttaaacaaaaaatcgaaaatgaaaaattaaagctggcacagcagaagatggaaaaaacagaagacagccaaaagccgattgacattgtcattacgcggaaagaggaacggccatgattgaaaaagcggtcaacccgcgctttgaagattatttgttcaattggaatgaaacgtaccaatttctcgtcggaggctacggctcgtcaaaaagctatcataccgcgctgaaaatcatcctgaagctgcttcgtgaaaagcggacggcccttgtcgtgcgggaagttttcgatacgcacagggattctacgtttgccttatttgaagacattatcacggagcttgaactgggacatgccgtaaaggccgtttcttcaccgatgcagctcagattttcaaacggaagccggattatgtttaaagggatggacaacccggccaaattgaaatccattcatcatatttcactgatttggattgaagaatgctctgaagtgaagtatgaaggctttaaggagctgatcggccgtctgcgtcatcccgagctttcgctgcatatgatatgcaccacaaatcccgtcggcacctccaattggacgtaccggcatttttttcgtgatgaccaaaaaaaacggttcgtattggatgatcagacgctgtatgaaaaaggcaccgtcgttaagggagatacgtattaccaccattccacagcgtgcgataatctgtttttgccgaaaagctatattaagcagctggacagcttacggcattacgatcctgatttgtaccggatcgcccgcaaaggacggttcggcgtcaacggcatccgcgtgtttccgcagtttcaggtcatggagcacaacgaagtaacggagcggattgcgtccatcaggcgccccctgtttcggaccggcatggatttcggttttgaagagtcatacaatgcggtcatccggctagccgtcgatccggatcaaaaagagctttatattttctgggagtattacaaaaacaaaatgaccgatgatcagacagctgaggagcttcaagaattggcggatcaaaaagagctgatcaaagcggattcggctgagccgaaaagcatccaatatttccgcaggcagggattttgcatggttgcggccaaaaagtttccgggctcaagacttcagtatacaaaaaagctgaaacggttcaaacatatctattgctcagacagctgtgaaaatacgatccgcgaattgcagaacttaacgtacgcaaaaaacaaaaacggcgttctgtcggaagatgagttttcaattgatccccacacactttcagccatttggtatgcgctggatgactatgacgcggcggatctgaaagatgcatcacaaaaacggagacgtccgaatcgggaaaggaggagataggcgttgcctaactatcaaaacgttagagccaccgtctttaaatcaaaaatggccgcgccgcaggcaaggcagatgaacgaagatcaatttgccgatctgtacggcgaagacatcatttcaccgccctataatctcattgaactgaaaacaatcgccgaatactcgacgattcttcagcagtgcattgacgcgtatcgggtcaatattacgggttttgggttcgatgtggaatatacctttgatgtaaatagcccagattgctcaccgtctaaaaaggcccgggccgaaaaaaactggatgaagctggagagcttttacaaatgtcttcattttgatgaatcggccgagacggtcctcggatatgcgatagaagaccgcgaaaaaacgggcaacggttttctcgaagtgcttcgggacggcgcgggaaaaccggcggggattgaatatctggatgtgaaacatatgcgcgtctgcggtgtgactgatcccgttgaagttacattttcatatgaagaaaacggcgcatccaaaacgattaaaaggcaaaaacggttccgtaaatatgttcagatgctgaacggacggaaagtgttttttaaggaatacggcgatccccgcatgatggacatgagaaccggtgaatacgtaaagaccctgtctgaagaataccgggcaaatgaagccattcacttaaaaatcggcagcggcacttacggcattccgcgctgggtcggcaatatcgtcaatctgtacggcgcccggaaagcggaagaactgaattttatgtatttcaagcagggccgtcacgtgccggccgccattacggttgaaaacggcatgctgtcagaaacctcgtacaaagagcttcaggattatatgaatgacctggaaggggtggaaaacgcccacaaatttctgctgattgaggcggaaggcattgcgaaggaaaaagaccttcacggaggcgaagacattacgcccgtgtctgtggaaattaaatcacttgcggaaattctgcaggatgatgcgctgtttcttgaatatgacgacagaagcagaaataaactccgttccgctttccgtctcccgccgctttatacgggagaggcgcaggaatacaacaaagccacagccgatacggcacggaaaataacggaggagcaggtgtttcagccggagcggaaaacgctgattaataagctcaacacgttatttttgcctgaactgggtctccacgatgtacagctcacattaaaagggcctgattttcgcgatccgcttgaaattgcgaaggtgcttacgccatttatttccgccggcgcggtctctcctaatgacctccgtgatctggcgggaagagtgctcggcaagacgcttgaggaatggcctgaagagtactacagccggccggtgctgaaagggaaataggagcaatcctgaaagggggtgaaaacatctcgtgccgagagaattgagaaatgccgtcatcagttttgtgagctatgtcgataaggcggcgaaccaaacggaattcttttttacaaaatcagccggaggccttccgtcatttgaaaaaaaggtgcaggtgtttacaaaaaacgaatcggatgagcagaagcttgtttacggcatcgtttacgagccggatgtccccgatgcacatggcgattatatgacggctgaagagattgaaaaggccgctcacggttttttggcggacgcccgcaacatcgatacaaatcataattttgaaggcgggaccggcgaggtggtggagtcgtacgtcgccccggatgactttgaaatcgggaatgctgtgatccggaaaggatcttgggtgcttgtcaccaaagcttccgatgaagtatgggatcagattaaagccggtatcattacgggctacagcatggcgggaaccgctgacgtttacgaagagccggcagaaaagcaagccggcttattcggcgcagtcaagcaatttctcgaccgtgaccgcaaatcaagaaaccgcaagggagaggacttgaacaagatgagaaaagaagacgtaagagaatcgattgaacacgcgctgcacccgcttttaaagcggcttgacagtttggaccagaacacggaagacaaagacggggcggctgcgccgtctgatgaagaaaagctgaaaacacttgttgaggacatgctggcgccgattattaaacgcattgaagcgcttgaaaaagtaagaggcgcatcaaagcagccggaagaagagacgggcggtcaagagcctgttaaaaaatccatttggagcggactgctttaagcccagtcagaaggaggaactgtagagtgagaaatcaagatatcatcagaaaggcggaaatgtcactttccgctttaaaaagcggcggtttaatgaaccccgcacaagcttcagcatttatccgcatggtgcagaacacgccgaccattttcagcgaatcgcgtgtgattcaaatggaaaatgactcgcagaaatttgaaaaaatcggtttcggccagcgtattctgcgtgccgctgaggaaggaaaagccttaactgacgatcagctgaccgtcccgtcaacaagtacggtgcagctgaatacgaaagaagtcattgcggaaattaatatcacctatgacacgcttgaaaacaatattgaaaaagacggcctgcagcagacgatcatgcagattttggcggagcgggcggcagtcgatattgaggagctagtcgtaaacggcgatacatcttcttctgatccgtacttggcacagcttgacggaatccgtaagcagactgtatctcacgtcattgacggaaacggggaagagctgtccagagccacatttaaaaaaggcttaaaagccattccggcaaaatatttgcgactgcctcaggaattcagattttacacatctcaaggcatggagattgaatggaaagaccgtgtggctgaccgtcagaccaatctgggagatcttgcggtgcagggcggtttgtcttcagcattcggcgttccggtcaaaggagtgtccaatctgcagccgtactcagtcggagaaggtgattcccagtacgatgcgtctgacatcattttgactcacccgaaaaatatcattctcggtttttcaagaaatatccgaatcgaagtagataaagatattcgcagccgcaaatttattatcgtactgacggctaaacttgacagcaaatttgaagaagaagatgcaagcgccaaaatcgtaaacgttaaagaataagacgggggtggcagttatgttaattcagccgtctgacgttgtttcatattcagtttatgatcaagtcaaaaacaggccggagccgcttcttatacaggacattctggaggcggaggcggaggcggccagaatggcggggcattcgttcactgaccctgtttactcaccgcttcccgaaaagattaagcttgcgttattaaagctttctcaatattttgcgctgatcaaccagaatgaagcagccgcttccgcctatcaatctgaaaagataggcgactactcgtatacggtggcaggtgaaggcggaatcagaaaaccggcggtgcaccatctgctctgtgaatatatcgcgccgggttattctccggtttctgcacacgcaaaggtgagacctttatgagctacgaacggctgctcactgacagatgcgatatttatcatgagacggtgtcagttccgaaggccggacgcttcgggattcccgccgaaaagctccagcctgtcttttcttatccggaagtgcccgattatgaagacgtgccgtgtctgtttgttgaaaaacagcagcagcttattcagcttgagcctgatcataaggtatatcagcggtttctcgttcattttccgaaagaggccgttgtgcgtgtcaatgacaaaatcatttgggaaggacaggcgtatattctggaaatgccgaagaaaacaagacagcaccattgggaggttatcgctgtgagagatgacagactatgagcataaaaaaccttgaacaatggaatcggtcgctgcaaaaggcatcatccggagaatttgcccgtcaggcaggcgaatggctggaacagtcaggagaggattttctcgacttggtacgggaggagcttattcattcgggcgggattgatacagaaagcctgctgtcttctttccggaaaggagcgcaggatcacgtatggatcattgaaaacgggggactgacccttgaaatcggcaccaatgtagagtatgcctcattcataaatgacggacattggaccgtctcagatgaaaatgtcagatgggtgcccgggtattttcaaggctcccggttcatctatgatccgtcagcttcaacgggaatggcgctcaaaaaacagtggatcagcggaaatgggttttgggacaaagcccttcttttgtatgaaacactcttcgccgaatcgctggacaagcgtttcaatcagtggcttaacacgttggggggagatatcggatgaatcgcgagaccggttcaatcgccgcttttttgtatcagcagtgcggcgtgcccgtatatgaaaatgaactgcctgaacaatttcaggtgccgtcactttacatcccgcccccgtatgcttttgacgagaatgacacagtctccacctttaagaagacatacagtctgaatgtgaagctgttccatgccgactcggtgcaggccctctatgcagccgacgggatcgccgatgcggtgagagaatcaagacagctgattccgctgcttacggaatcaggggaggataccggtgatttcgtccgcatcagccgtatcgaaacaagagtcggagacaaaggcgaggcagtgatcaccatccgctggacgagccgctactactatcaaaaacaaacatctcccgcactgcgggatgtggacattaacagcggggtgaaacaaaagtgaaacaatataaaaagaaaaacgccgcaacggcggaacgagcggttctttatgacacggcggatttaacaaagcacgcgaaggagcttttcggcgtaaaacccgagattctccagggtgctttattcggcgtgaagcaaaaacaaatgacaaaagcgcaagccaagtcttacattgaagcatttttaaccaaggaggtcatgcaataatgaacggcggaacatttacgcaaggaaaagaaaaagaacgtgccggaatctattttaactttaaaacaaccgcccaggagcgggtatcgatcggtgaacgcgggattgtcgcccttcccgtcgcatccggctggggggaagcgaaaacattcgtttccatttcaagcgttgaggatttgaataaaaaagtggggctcagtattgaagatccgtcactgattctgcttcgtgaggcgaaaaagaaagcaaaaaccgttttgatgtaccgtctgacagagggaatcagagcgagcgcagatctttcgcaaggtgttaaagcaaccgctttgtacgggggttcaaaaggaaatgacatcatcatccgcatcagtgaaaacgtccttgatcagaccgctttcgatgtgaccacttacatggatgaagcggaagttgacaaacaaacggtgaaaaaagccgaagaattaaaagcaaacggctatgtcacatttacgggaacgggcgaactgtcggcttccatcccgctgacaggcactgaggaagaatccggggaaacgttaaacccgcaggcaggcatccgtctcgcgggaggaactgataaagcaccggtcaactcagactatacggattttttagctgcggctgaaacggagaatttcgatgtcatcgctcttcctgtcgcggaaaacgatcagctgaaagcgacatttgccgcattcattaaacgccttcgcgatgcgcagggacagaaagtgcaaggggtgaccgcccattacagcggggattatgaaggcattatcaatgtgactgaaggtgtgctgctggaagacggaactgagattaaagctgaagatgcgaccgcctgggtggcaggcgcaagtgccagcgccgcatttaatcaatccttaacattcgttgaatacgaaggcgccgtcgatgtgctgcaccgcttgactcatgatgaagtgatcgaacgtctttccaaaggtgaattccttttctcttatgatgcccgtgataagtcagtcagcgttgaaaaagatatcaactcattggtgacatttacggcagagaaaaacaaaaagttcgcgaaaaacaaaatcgtccgtgtgcttgatgcggtgaataacgatttgacacgtgaactgaaagccttaattaaatcgaaaaaaggcaccggaagcgatcttcctgcgacaaatgacggccttcaattcgtcaaaacgatgattattcaatatttgacaacgctccaggatgcgggcggcatcgctaactttgattcagacaaagacattacaatcgggctgaatgaagaccgcgacggctttttaatcgatctcgccgtacagcctgtggatgcggcagaaaaattctactttaatgtggaggtaaactaagatggcattaaaagcgcaaaacacgatttcaggaaaagaaggccgtttatttctcgacggagaagagatggcgcatattaaaacctttgaagcaaacgtggaaaaaaacaaatcagaagtaaacatcatgggccgccgcatgacgggacataaaacaacaggcgccaacggaacgggcacggcaacattctataaggtcacatccaaattcgccgtccttatgatggattacgtcaaaaaaggcagcgacccgtattttacgctgcaagccgttcttgacgacaaatcatcaggccgcggaacagaacgcgtcaccctgtatgacgtcaactttgattctgcaaaaatcgccggactggacgtagactcagaagccctcgaagaagaagtgccgtttacctttgaagatttcgatgtgccggaaaagctttctgaaacgttttaaccagaatcattgtgagtgaaacaggccttttataggcctgtttttttataaaaaaagagtaagggagttttcatcatgagcgaaaaaaacgaacaagtatatgatctgtcattctttatgccgggtaaaacagtcgaggctgaggagatccgggttccgctttcaaagcgttttgtcgataaaaaaggaaacatcgtgccttttatttttaaagccattacgactgagcgcattgacgaactggagaaggaaagcacgacatataaaaatgtgaagggcagaggccgcgtaaaagacttagacagccagcgcttctatgcgcggatcgcggttgaatctacgatttaccctgatttccggtctaaggagctccgcgacgcttacaaaacggcagatccggtcgaggtggcaaaacgcgttctttcagtcggcggtgagtatgcaaattggctgaataaagcgattgagatcaatggttttgaagatgaattagaagatctggagcaagaagcaaaaaactgataaaagatgggaataaggaagccgtgtatctctattacgcgatgcatgagcttcattattctccatcagaactgaaagagttatatgaagcaccgagacattttaaggcgctgttgtacggtttaatcggttacaagctggacattcttgaaaaacaagcgaagaaagggggagcgacatcatggcaaagctgaccgcccgttttgaattggaagatcgggtttcaaagaaaataaggaaaatccaaaatggcttcagagcgcttgagaaatacaggaaaatgacaaaacgccaaagtgaaattgatatacgcaaagagagtaaatctgttttaagaacaattgaccgcatccagcgctctatgaaaagaaagctgggcgcacaaatgatctctatttcagctgaagacggagccagtgccgtcattcaaaaggtgcaagcccaattagcgggtctgcctgcgtctttaaccgttaaaataggagcaaaagacagcgcgacagcggcatttgagagattgcgggatctggctgccggttttaaaggatttaccgtttcactgtatgcgtcagacgaagtgactcctgccatggaacgtatcaaacgctacatgcaatctgcgttaaagaacgggtactctgtcactatacgcgtcatagatcacgtcatgaaaacagtcggccgaatttcagcggggattgattcgctgacggggaaaaacaatgtcattcaattatcgttaaacgaaaaggtgacagcacagctggctgcaatgcaaaagaatatgccggacgtcggaaaagcttctgcatctgctgctcctgcttcgccgaaaaatgatttttcaatgcttgactccattgcagacaccttcatgaaaaaagtcaatgatatcgcatccaaattttatccggaaacaatcatagcggaactggataaattcgctgcaagctttatgaagaaagcggacgaaatcgcgagcaaattcagcccggagacaatattagcagagctggataagttcacgacctcattcatggggaaagtggatgaaatcgcaagcaaattcagcccggcaacgatattagccgagctggacaagttcacgacctcattcatggggaaagcggatgaaatcgcaagcaaattcagcccggcaacgatattagccgagctggacaagttcacaacctcattcatggggaaagcggatgaaatcgcaagcaaattcagcccggcaacgatattagccgaactggacaagttcacgacgtcattcatgggaaaagtggacgagattgcaagcaaattcagcccggagacgatattagcagagctggataagttcacgacctcattcatgggaaaagcggacgagattgcgagcaaattcagcccggcaacgatattagccgaactggacaagttcacgacgtcattcatggggaaagcggacgagattgcgagcaaattcagcccggcaacgatattagccgaactggacaagttcacgacgtcattcatgggaaaagcggacgagattgcaagcaaattcagcccggagacgatattagcagagctggataagttcacgacctcattcatggggaaagcggacgagattgcaagcaaattcagcccggagacgatattagcagagctggataagttcacgaccttattcatgggaaaagcggacgaaatcgcgagcaaattcagcccggcaacgatattagccgagctggacaaattcgctgattcgtttatgaaaaaggtagacggggtcgtgagtaaattcagtccggaagccatattgaaagaactggataaattcactgattcatttatgaaaaaggttgatgacgttgtcagcaaattcagtccggagaccatattgaaagagctggatcattttactgattcgtttatgaagaaagtcgacgacgttgtcggtaaattcagtcctgataagctaatcgaccgcgccgaacaatttgtaaatgacacgattgaccgaatttctgagaaattcgattttctcaatccggataagattctggaaaaagtggagcagtttacttcctcactgttcggaggcattgataaaaagttcggcaagttcagccctgatgcgatcatcgaaaaagccgaggcatttgttgataaaattgtcagcaagattgccaagaaatttgagaaattcagcccggacaaaatcatcgaaaaagccggggaattaatagaaaaaatattttcaggaatcgctgaaaaattaggcaaactcaatatcggcggattattaggaggcggcacgaaaaaagaaaagagtaaggggagcctttctgccggcggcaccaacagcccgaagcgtcctgagctgacaaagggtccgcagcgcacgggaccatcaccgaaatcttcaggaaggtcagccaaaaaaaccggcggggctttggggggcggctgctgctgtaccggagtgacgaggggcaaaagcagtaaagtcgaagggcggaataaatcttcgaaaagaggttcctccgtaaaggaaagcaaacaggcatccgtaaacacgccgaaaacaaaaggggcaggtaaaggcatcggcgggcttttgaaaggcttaggagattcaaaggcgctgaaaggcggtatgaaagggttaaaaggtgccgctaaaggaattcccggcataggtgaattgttatcacttactgatttagccggcatcaataaagataatgcaggagagaaggtcggctcagcaggcggcggtcttgcaggagccgcggccggagcggcaatcggcagcgttgttcccggagtgggcacattaatcggcggcgcggtaggcggcatcgccggcagtttaggcggttccagcttgggagaggcctttgattcaggggctttgaaagacacatggaatgatatttccgaagcggcgcaaagtgcttggacaacagtacaagatacttggggaagcgtttcatcctggttcatggaaaatgtatggacgccggtttcatcagctgtcgccggagtggcgacaagcatctggtcaaatatcgtgaatgcatggacgacgattcaagggattttcagcacggtgtcatcctggttcatggagaatgtatggacgccggtttcatcagctgtcgccggagtggcgacaagcatatggtcaaatatcgtgaatgcgtggacgacgattcaaggtgtcttcagcacagtatccggctggtttatgagcactgtctgggagcccgtaaaatcggctgtcgtcggagtagcgacgtccatttggagtaaaatcacaggagcttgggataaaattaaatctgttttcagtacggtatccggctggttcatggatattgtctggaacccggtgaaaaacatggtggaaaaagtcggaaaaggaatatcagacgctttcacgactgctttagatacggtaaaggatatatggaaagggttaagcggctggtttgagaaacatataaaagaacctcttgtaaaagtgggaacagccatatcagatgctttttctgcagcattcgactgggtgaaaaagatttgggataaaaccggcggcaaattgatttcaggcgtaatggactttgtcacaggaggcggcggagataaaaagaaaaaaacggacaaaaacgccacgggcggctacattacaaagccgaccatttcctggatcggtgaagccggtaaagaatttgtcatccccgtcgacaacaatcgcggccgcgggaagatgctgctttcacaagctgcgtctaagctcggcatgcgtgttgtcgatgatatgggcgcggcttcggctcagtcttccgctgtgccggcgggagcgggcggtgtttcttcttcggcgtctgtatcggccgctgcgtctgtggatgcttccggatttgcggggacggcttcatcactcggcaaacagtttactgaaggctttgacagcggaatcagcaataaagcggtggatatggacggctggaaagagaaaaacatcggaacgccgtttaacgcccttatttcgtcttcgcccgattacggaaagcaagtcgctgcgggctatgccaaaggtcagaatacatcgccgacgggcaccgattcgtttttaaaaacaaaggtgaaaacaccttatcaatcggaggttaatcaatcgtcatcatggggcgccgccacagtgaaaggttattcggccggacagaatgcaaaagatacgggaacgtcgcaatacgtaagcacacatatcaataaaccgtttgttcaatcaagagattccgcgaacggctgggggtcaggcctgatcggacacttcgtatcagggatgactgcaaaaggaagcgaagtcaaacaggcggccaaagatatggccaaaaaagtcgaggacgcattcagggaagagcttgatattcactctccttcccgtgtcatgatgagtctcggacgctttgcttcagtcggcgtcgtcaaaggtctcagctcagttgacgtgaaaaaatatgcggaaaaacaggcaggctcgcttgcagcagccttttccggcatgggtgcagcgggaggaagcgtcaaagaatggcttttggccgcaatgaaagcaaccaatacgccgatcagctggcttccgggattaatgacgatcgcacagcatgagtcaggcggcaaccctaattccattaatctatgggacagcaacgccaaagccggacacccgtcacaggggcttatgcagacgattccgagcacctttgaagatcacaaagcgccgggcatgaatgatatcagaaatccaatccacaacgccgctgccgctatcggctatattaaaagccgatacggctcgatcagcaatgtccccgggattaaaagtatggctcatggcggcccttacgtcggttatgccaatgggggtctgattaccaaggagcagatcgcccgtgtcggcgaagggaacaaacgggagtggatcatccctgaagagcggggcatccgcggccgttatctgctgcaaaaagcggctcaggcgctcggcatggaagtgtccgatccgtcccggacggaaccggcggcgctttcagccggcacggtttccgcagccgttaaaggcggcggccaaaccgttcaaaaaacgggaacaaaagaaattaaaatcgaattcagcggcgatcagcatttccataacgggcaggacgccgagagcctagccgccaaaatcaaacaggcgctgattgatgaactgcaaaaagacatttataccggagcaaagggggccgttgcttttgactaaatctgtttacgaattttggctgtctcaagggaaggacaagctccggcttcccgttctccctgaagcgattgatatcgcaaacagcgtgcagaatgattccgtgaaagtcaccggacttggagaggtgacgtttatcgaagaaccgggagcgaaagaaatttcgttctcttctttttttccgaaacggtacagcccgattgccgaatatcaaagcattccttcaccggaaaaagccatttcagccattgaagcatggatgaaagcgaaaaaacccgttcagtttttgattacagggacaaaaatcaatgtcacatgcagcattgaaagctttaattacagcgaaggtgacaatgaaatcggcgaccggaattttgatatcgtactgaaagaatataaaaccgcttcgccaagaaaaatcaaacaaaagaaaaaaacgaaagcgaagcgcccgtccaaagcttcacccaaaacatataccgtcaaaaaaggggatacgctttgggacatcgccggcaagttttacggaaaacacacggagtggcggaaaatctggaacgcgaataaaaccgccatgattaagcgcagcaaacggaatatccggcagccggggcattggatcttcccggggcagaagctgaagataccgcaatgaaacgggtgaaaagatgattgaactatttgtcataaaagaaacggagtggctcgagcttgtcacagaaagcgtaacgctggaaggacacagatatcaggcgccccgctccatcgaagcgacgattgtcgtaaagcagggcagccagacgtattacggcgtatcagaaggggatacggttttgttcaaatggaacggaaaagagctgttccgcggcattgtttttgcaagaacgcccgatgagcataccgtcgccttcaccgcatacgatatgctccaataccttgtgaaaaaccaggacgtttacgtgttttccaacaagcgcgctgatcaaatattaaaaaggatcgccagcgattttcaaattcccgtcacatccattgccaacacaggccatactattaaatcactcgtttttaaaaatgatacaagcctttacgatatgatgctaaaagcgttaaagcagacaaaaagccagacggggcgcaattatcagctctattcagaaaaaggcaggctcggcttgcgtgaatggccggagccgtctgacatatgggtgctggaaacaggagttaatattacagggtatcaatacagcacctcaattgatgacaccgcaacccgtgtcgtcatgcggctgcaaaaagacaataaaacgataaaggcttccgcctcagacagcgccggcatgaaaacattcggcgttttgcagtataccgaaacggtttctgacgacattaacgaagcccagctgaaacagcgcgcaaaagtgaagcaggctgagaaaaaaggcattaagaaagagctgaaaaatatacaggcgatcggtattcctgggttggaaagcggattgcccgtctatatttcaattccggaaatcgggctgaagaaaacctattatgtagatacggaccgccatgaattccaaggaacaaaacataccatgacgattgacgtcacggagaaaaattcacttccggaggggacagcctgatgagattaagtgatgccattaaacatttagccgtcggagcggttgacgctgaagcgccggtggagctgatgccggccgaagtgacctccgtttcgccgctcgagctgaaactgaaagatcacgacaaacttttgattccgtctgatgcactcattgtgccgaagcggctgagatccggagaagatgatcagctccaggcgggagatcgggtgatgaccgccgctttaacaggaggacagtctttctttgtactggacaaaatttaaccggcatccggacggagatatacgggaatatcagcctattaaagccgcttcatctgccgaagagggcttttttacatgaacaaatctaaaaggagcgggtgcaatggccctgacaccggaaatcgaatttgaagatttggaggatgcgagtgaggctgttgagacttcacaaacctaccgaattgactttgaaaacaaccggattaccaatgaactgataaacggactggacgcaatcagacaattcgtctatatcgctcttcacacagaacggtattcatattcggttttcagccatgatatcggaaacgaacttcaggaagtgctttcagatcagaacacgacggatgcttataaaaaaatggagattccaagactgatagaagaagccttgctgtatgatgaccgtattttggccgttaccaattttgagattgagaaaaaagatgatgccttcatcgtctcttttaccgttgaaactgatgagggcatgcttgagatagaggaggtgctgggtgaggatgtttgaagctcagacgtttgacgacattatggacagaatgctggcgcgcgttacggcggatattgatacgagagaaggcagcgtcatttacaatgcgctcgcgcctgcggccgctgagctcgcaaagtcttatatttggctggataccgtgctggagctcgtgttttccgatacggctcagggtgaatttctggacaggcgtgctgctgaggcgggaattgaacgaacacctgccactaaagcggtcagagccggagaattcacagcgggcatcaccattccgccaggctcccgtttcttcgttgataacctgtattttcaatatacgggggatggaacgcttgaatgtgaaacagccggtgaagcgggcaatgccggcatttcggggcagaacctgctgccgcttgatacgatacccgggcttgagaaagcagtcatgcgcgatatattaattcccggccgtgaggaagaagatgacaacagcttaagggcgcgctattttacccgtgtccgccgggaggcagtcagcgcaaataaacagcattataaacaatgggccgaagagattgacggcgtcggcagggcaaaaatcttcccgctttggaacggagacggaacggtgaaagttgtcatcacaaatgcgaatttggaaccggcatcagatattctgatcaaaaaagtaaaggattatattgatccggacgaagggcagggagaaggacaggcgccgatcggagcggcagtaacggtggaaagcgcagtatggaaggaaatcgaaatctccgcttccgtgctgcctgagctgaacagctcgatcgatgacgtaaaagcggagattgaaaaaggcgtactgaatttattcaagaaaatggcctttgaagaaaacaccgtccgtttatcacaaattaacaacatcgtttataactcggcatccgtcagtgactacgccgatattaaaatgaacggtgcggcagaaaacctcgtgctcagtgacgtggaaattcctaaactcaaagaggtgaaaatccttgagcagactcgatgagatgacggcgtacctcccgccgtttttaacccgattaaaagagatggcacaactgcttatggcggaagctcctgagtttgagcggcagaataacgatattttcgatttgacggatcagctctttatcacgacggcgacatgggggcttgaccgctgggaaaaaatattaaaaataccgcgggaatcaggtgacacggaggatatgagacggctcaggctgatctcgaagatgtcgaatattccgcccatcacacatcaagcgatcgagcaggcgctaaaccgttttttaaaacatccgtcagcttatgttcggatgtttccggggcagtatcgtttttatgccgatatcgggcttgatgacctgcagcacatgaacgagctgattgaaacgcttgaaaaaatcaaacccgctcatttggcgtatacactgagagccgcattaaacgaaacactggaaatcaaagaccgggtcattctcaacaatcggagataccgaaaagtcagtgaactgaaggtcggttattccgtcacactcaacaataacgaggtggtcttaccatgatatcagccgcttacagacagcgtgccgcagccgatctgaaaaacaggatcacaaaagtgctgttaaacggcaaagaaactccgattgcggacatttccgtaaaagatgccgcagtcaccgttctcacacgcagggaagaagacgtcaaacacattgaaaccgtgcagatgcttgacgaaacaggaagcgtcattacagaacgaaaaacaaatttagatctcagcaataacagaacgcttgatttaagatttacctttgaggtggtgtaacgatggcttacgaagaaaaaacagactggcttccggacgatccgattaatgaagatgacgtcaaccgctgggaaaaaggcataaaaaacgcccacacggatctggcggcccataaaaacgacatgaacaacccgcacaaaacgacaaaggcgcaaatcggcctcggaaacgtggacaatgtccagcaggcagcaaagaaagattttgaccggcacaatcaagatctggaccggcatgtgacgaaagaagagcgccagaagtggaataacgggcaattgtctaaaatcacaaaagatgatggctccgcttttattaatatctctgacggacaggattttcatcagaccgctgccagccagaataagacctttactttctcagcagctgcaaccggaataaataccccgcctaaaccgtcagagggtatatacctttattcttcaaagaataacggagaggcggccgctttctcagatgacgggggattttggagaaaaacgctgaaaaacggcatctggacggaatggatgccatttgaaacagctgccggagcacaagcaaaagtaaatgagcatgccgacaaaacagatcttcatgtaaccaagtctgacaaagacaaatggaatgcagggcagttattcaatctgactgacaatgacgggaatgctaaaacggtaacagaaacaaacttagacaatataaaaacgtccggcatctactatatatcagttcagcatacagaaaataagcctgcggaatacggacaattaattgtcatgcaaagaacccgcggagcatcaccgacttttgtccaaatgtttatagacacagtgaccgccggaaatcccatatacgtccgaagtttcagcactaaaggcgtatggtcggaatggagccaacaagaaacagattcaggctctcaagcaaaagtagaggctcacgccaataaaaaagacattcatgtcacacaggcggataaagatatgtggaacggcgcacagctttcgaaaataacaaacgataacggcggctatcttctgacaattggtgatgatgataactttcttgaaaaaatcgttaaaaacggcagggcgttcggcaccttttattcaaccggcaaagcggcaaacagtccgagcaacgcttcaacccgcggcatgtttcattttacctctcttgacagtgaggggaaaggaacgtttgggtatgtcattgccgtcgattataaaaataatatgttcacgaactatttggatttgaacttgggctggcagggctggcgtcgcctcgttactgaacttgatactgagaatgtaccttggataaatgttccttataaaaatggcgctaaatcaggagacaggccgcttcaataccgtaaagtgggaaacacccttcacctgaacggacacgttcttacggacagagaagtggtattcgggagtgtgccatcctcttgtgcgccggccaaaggcgttgtaacgatggttgcagccagcggcaccaccggttacagcaaatttattatctattctaatggagatatgaagctgacgggaattatggccaatatagaaaataacgtgaacggctattatattgaccttgttttggcactcacgtaaaggagcgagaatatgaaattaatatttccgtatgacaatgacaacatttatacaggcactccggttgagctttatccggattctgagacaggagattatgtgatgccgcctaacgctgcgggctttccgccggaaataaacggcgaaggcatgtggcgcccattttttgatgaagagaaacaagaatgggtggaaaccgctgacgaagcatataaagagagcttaaaaaaagatacggctcccgattcaaaccagcttgcaggcctcggcggacagctggcgaatgagaaattggccagaaaagcagccgaacaagcgcagcagtcactcggcaggcaattagcgtctttaaaactggaactcttaaacgtaaaaggagaatgaaaaaaatgaaaaaacttaacttttgggtttacgccttgttttatgagtgggcctcaacagaaatggtaaaacaggctatgggctatgatgactgctctgccgaagatctggctgaaggggtggccgcgaagtatatcacgcctgaggaatttcaagaaataacgggtgaaacatacgaaaactataaaaatgctgtgtcataagccaaacggctttttttatttgtcatttttaataaatgagaacaggaggacggccgatgaaaaagcattcatttgaatttcccgccgatcaacttggcaggcccggcgccgtaaaagcttatcgcggtaacaaaaacgattatgtcacaccggttgctgatttgtccggaatggcagagcttcttaccaatacgccgctagaagcgattgaagtctacagccaattcggacaagaccgtttaggagccgtcttaatagacagagcacaggggtgggcttattcggaccgcagcggaactctttttatcgaagagagcgaggataacaattcgtggacagcttcacattttgtcgcagtaaaaggcggagtgctgaccgcttcggggtgggtcagcctgacaaaaagatattaccggttccgttttgaaaatggaaatcaaaagcagtccgaatttgttttataccaatctgtcggtacgggcggtgatatggcgttttcatatacagacgtgatttttcatgaaaatgcagcagaggcgggcgagggaagcatcttctcagcaggcgcttggaaaaaacttctcgtcgaaatcaccggtacggctgagtcgggccatgtcgcgttttgggggagatccatctcgggaaaaaatgtgccgatcagaggaatcaggtctgatgacgggacatcagccgccggtacgtcaggcacagaagaagtgtggtcatttgatattgccggctttaaggaaatcgtcatggaaatcaagagcatttccggcgggagcctttctgtcaaaggcacggcattttcttaagaatgaagcttccgaagggaggtgagaacaatgtaagaggagggagcggaagtgcttctggatgaacaagcggtgcaaaaagaattcgcagacatcaaaggtgaacaaaaggtgcttgaacagcgggtagccgcattagagcgggtatcagaccggcaggatcagcaaatcatgacgctgaatgaaaaactgaacaaaattgacgaaaacacaacatggattaagcggaccattacaggagcgatcgtgacagcaatctgcacgggcgtcattggcggagcaatcgccatcatgtacaatctgctgcaaaagtaagggggaaaccgatatgaaattcgcggacaaaggcacggtcgtcaggacggtgcttcttttgcttgctttattgaatcaaactttgctgatgttcggcaaatcgccgctgaatattcaggaggaccaggtcagccagcttgcagatacgctgtatgccgccgggtcggccgtttttacaatcataacgactgccgccgcctggtttaaaaacaattatgttacagcaaaagggaaaaaacagcaggctttattaaaaataaacaatttatcgaaataggagagatgagaatatggtaaaaatcacacaggattttatcccggcaggaaacaataaccgcccaggctatgcaatgacaccgatttacattacggtgcacaatacagccaataccgcagtcggagctaacgccaaaagtcacgcaagctatgtgaaaaatcccgatacaccgacaagctggcatttcacagtcgatgatacggaaatttatcagcatcttccgctgaacgaaaacggctggcatgccggtgacggaaacggggacggcaaccgtaaatccatcggtattgaaatttgtgaaaacgcagacggcaacttttcacaggccgtggcaaacgcccaatggctcatccgcacattaatgacgtcgcacggcatcccgcttgcgaatgtcgttgcgcacaagcattggtcaggaaagctttgtccgagaagactgctggatacatgggatgagtttaaagcgggaatcggttctgaggaaagacagacgtataccgtccaaaaaggagatacactgtcggcgatcgcgcggaaattcggcgtcagcgtggccgatctgcagaaatggaataacatcgctgacccgaacttgattaaagtcggacaagtgctgatcgtcagcccgccggttgaagcactgtattctcttccggacgaggtgatcaagctgacagagccgtacacgtccggtgaaaaggtataccaggtgcagaacgcgctcgccgcgctttatttctatcctgaaaaaggagctgtcaataacggcattgacggtatctacggtccgaaaacggcagatgccgtggcccgcttccaatctgtaaacggactgacgtctgacggcgtctacggtcccgctgtaaaagcgaaaattctgatgcagctttaacaaaaaaagctgagtcccgttcacattgcgggattcagccttttttcttttttaaccggttcaataacccgagattcctcgcccgcatcctcagcgaataagcggaaagcccgaagcgtccgtaatccacaaactttacgcgtctgacaattttcttcacatcatcacctgtcgcatctctttgttggttttattatatgaaagatatggaaaaaaggaataaggacaagagccgtgtctcctgtccttagtgtaatcaagcttttttttgtttatacttgtcaatcagccgctcgttttctttgaaaattctggcggtatgagggctgacctggtaacttgcgatacttgtcattgaacgttttttaaacattttgaacggtttcgctctttgttccggctgcccgttttgaaatgcctgctccatttaaccgtcaccttcctcttctattggcagcattaaatcataaatgctcgttagcgatgtgaaaagcaaataatcgaattccgtcaacaggttttccgacgtgagtttgatcacgtaatggcggtcctggactgtaaacggaataagcacaagcctgcctttttgatcatagtagacgtctttacggttaagacgggactgaacgtccgccgcatcaggcatatgctccgtcaagcggtccttatccgattgtgcggaatagtcgcacaaggaagccgtgacattcattttttctccataagcggccagcagtctgctgatgccttccgcataagcttctgtacttccataatatacatggatcggttcatttttcaacagatattgataggttttcagtttttcaagataggagtgaagcatttcgttattttcttctaaaatttcccgcgtatccgtctctaattcattgccggcgagctttttgatatacgcgctcaaaaagataaacgcatcaataagggcaaagcagacggcaacaatcaaatattgtctccatgcggcaaagagcgattcgggatcatatgtccaatagaccatggcgcctactacaaatagtaaataccacgttttacggatggcaaacattttttcttttacctttgcttcataccgccaggatgcgtacacatataaaatgagtgcggccgccatcgtccacaccatgatctgaaaaaacaaaagcatgagcatccctcacaattcgaaaaatggtctgctatgttcattctatgtcatgacatcattttcctgtcacaaaaaaaaccgcttctgtaaagaagcggatgtcatcagaaaaagagatctaagatgaaaaaggcgatggcgccgagtgtacctgcaatcggcagggtgatgacccatgtaataagcatccgtttagccgttccccagtttacgccttttacgcggtgggaagcgcccacaccgagaatggaagacgaaatgacgtgcgtcgtgctgacagggagatgaataaacgtggccccgaaaataatggctgcgccggttaagtcggcagatacgccgtttaccggacggattttcataatttttccgccgacggttttaatgattttccagccgccgatggatgtgccgagacccattgccagggcgcaagagagctgcacccaaaaaggaatggcatcacttttatgtaaattggccgtcataagcgccatcgtaatgatacccatcgctttttgcgcgtcgtttgttccgtgtgtataggattgaatggcagccgtcaaaatctgcactctgcggaagcgtttatttgttttcgccagattgctgtctttaaaaatcagcttcacgatcgaatatacgataaagccgagaacaaaggcgataatcggcgataaaataagtgcttcgataatcttaatgaaccctttataattaagcgtcgcaaaacctgacgctgcaatggccgctccggcgatcgctccgataatcgcatgtgaagagctgctcggaatgccgaaataccatgtgatcaagttccaggcgattgcggcgagtagagccgccagaatgacaactgacccgttgtctaatgtataaggattcacaatgtccttcgtaatggttttcgccacaccggtaaatgtcatcgctccgagaaagttcatgatggcggccatgacgattgcgtgccgcggcttcagcgcttttgtcgaaactgaggtggcgattgcgtttgcggtatcgtgaaatccgttaatgaagtcaaataccaaagcgcatatgacaattaatatcgttaaaagtaatagagtatccattataacccctcgttacgcgtttttcataataatggtttcaaggttattggcaacgctttggcaagagtcggcaatttcctcaagcgtttcgtaaatctcgcggtactgaatcactttaatcggatcggtttctgtgccgaacagattttttaatgatttacggtgcaggttatcacagctgtgctcgtattccttaattttaatggcgtgagggtgaatgtccttcaatcggttttctgcaagcagctcaatcgtgattaaaatttccttcgcgcactctctgatgtatccgctgaacttatcgatatgctcatctgaagaagtgatcgagaaaatctccatcattgctgaaaaatgttcgattccgtcaagcacgtcatcgaggctgtttgtcagctcaaggatgtcttcacgttcaatgggagtgataaaagctttgttcagctctttaatcatgacatgaacatgattatctccttttgtttcaaactcttttaacgtatcggcaaattcctttaaagtcgtctggttcgtcactttaaagttgacaaagtattctgcggtttcgtctatgttttttgcgatttctgttaaaaggagtgagaacttatctttttttctttttatcattaaaaaccctccattgtttgaatgagacaatgcacacatcaaattattatatagccttttgtcgaaaaaaaacagataaagtcgaaaaaaacgcctcttgattttttcgtaaaaacgtgtctcatcctgtttttcttatgttacccacttcgccaaaaaaacgtaacatacttcgaattcagacatcttgcttaaaaagtataacaaaagatgtgaatttgctgtcaacttttgcacgtgattttgccagaaaaaaaacggctcccgtaaaaggaaccgtttttgtcagttttttctgccgtttttcagccaaaaataaagcggcagcccggcgaggccgatcaagagggacagcgcgcagctcagtgtatctgtaatgatcgtgctgatcagcacaaacagtgaacccgcgatggccaaaacaggaatgatcggatacaaaggcacgctgtaggcgcgcggttttccgccgcttttttttctgaggataaacacggcgaaaaaagccatgacgtaaaaaatataaatcatgaaaatagagatctcagacagcttatcgggattgctggcgatcatgaaaataatggccagcgcgatctgaaatgacacggcaatccacggggtgcggaatgtcggatgcacccgcgaaatctgtccggcaaacggcagctgtttccgttccgccatcgcaaacgagacacgcggaaaagcgagaatctttccgtttaaacagccgaagatgctgacgatgattccgacgctgatcaattttcccccgatgtcgccaaacagcattccggcagcggtgccggtcgcattttcaccgagtttgacgatgtcggtcgcaggaagaatgtgcagcagcgcaaagttaatgaaaagataaatggcggtgacgaccaagagtccgcccgtcatcgctcttgggagcagcttttccggatttttcatttcgccgccgagtgccgcaagcagaatccatccgtcataagcaaacaaggtggccagtatggcggcgccgaaattcatttccgacatgctgcttgtgacggctgtgaaaatatgctgatcgcctttccaaaggccgaacacgatcatgcagataatcggaatcaatttgccgacagtcgtaattccctgtacgatgccgccatatttcgttccgataatgttaatgatgcttaaaaataaaacggctgaaatcccgattaatttagaccagccggaatcccaattgaacaagtgcgccatcaaagagccgaaatacaagccgattgctccgataatggcggggccgtaaatgataatttgaacccatccgcacaaaaagccccaaaattcgccgtacacttcttccagatatgtataaagtccgcccgttttcggaatctgagtgccgatttccgcaacggtcaagccgccggcaagcgtcaaaatgcctcctaacagccacgcgataagcgcggttttcgcatcaccggagtaggcaagcacggcgcctggtttcataaatacgccggaaccgatgatggtgccgataacaagtgagagggcgatggtaaggccgatctcttttttaagtccattctcttcaatctgcatatcctttccctccagatgtaaaatcgttatgctgaaaaaactattttccatattgtaaaccctaattgctgaaacacgaataaaataaattttctgattttggtgttttgcctaaaagataaaggtttatgcttttgagaaggaaaaaatactgttttaaaagcgaacattaatggttttttaatatcaaaagttcgttattttgagagcggcagtctgcagaccgtctgtgaagcagatgggttgactttacgatccggataacataaattgtatatataaaatatctcgaaatcgagataattgactggaggataacataatgaaagttaatggaatacaccatgtatcagcattgacggctgatgcgcagaaaaatttagatttttatcgaaatatcctggggctgaagcttgtgaaaaaatcggtaaaccaggatgaaccgacgatgtatcacttattttacggtgatgaatcagccaatccgggatcggaattgacgtttttcgagattccgcggatcgcgccgttccatgcggggacaaacagtatttcttcaatcggcctgcgtgttccggatgcacaagcgcttcaatattggaaaaaacgatttgaagagcatcaggtctctcacggtgagatcgtgaaaatagcgggcagggacacactcgcttttcaggatcatgaaggacagcggcttgtgctgacagctgacgaaaaaggaaaagacatcggtgaagcggtgaagcaaagcggcataccggaagaatattctttccgcggtcttgggcccgttgaattgaccgtcccgtatgcagaaccgacgctgcgtgtgttaaccgatgtgctgggcttcactgaaatcgggaaagaaacacatgaagaccggggcgcggttacggtgctcgaatccggaaacggtggcgcgcgtacagaagtccatctcattgaaagaaacgatcttccgcgcgagcgtcctggaaaaggcagcgtgcaccatgtggccttccgtgttcagaatgaggaggagcttgctttatggcaccgcatcattacgaaagaaggtttcagcaactcaggcattgtagagcgttattatttcaaagcgctgtacttccgggaaccgaacggaattctgtttgaattgtcaacggacggtccgggatttatggttgatgaaaaacctgaagagctaggcaaaacggttgcgctcccgccttatctcgaacaccgccgttctgaaatagaagcgcggctgaaaccgattcagtaaatcagaagtaatgaaagatgccttccggcttgacgggggcatctttttttttgcttttttacccgttttgtcattctttttacctatttgtaaacggcaaaataaatgtctttgtttattaataaatttttcacatttggttgttacacttgttcaaagttaaacaaaaggagtgaaaacacaggtgaaaatgaaaaaacgcgagatagacgcagtcttaatccttattttactcgcttccgcattcttgaatatgtacaacatctggaatgacgatacggtgaatccttattacaccgcagcggtaacgagtatgcttcaaagctttcataatttcttttacgcttcatttgacgcagccggatttatcacggtagataaaccgcctgttacataccagattcaaacgatcagcgcgctgatattcggtatgcacgggtggagtgtcatcctgcctcaggcattggcgggggtaggttcagttctattcatgtacttattaataaagccgacgttcggaaaaacggcggcgcgcatcgcttcgtttgtcatggcgtgtacaccgattgctgtagccgtagcgcgcacaaacaatgtcgatgctttactggtctttttcctcttgttcgccacatggcttctctttaaagcgattcgaaaaggaaaactgatctggcttttggcggcattttttgtcgtcggagtaggctttaacacaaaaatgcttcaggcttatatgatcttaccggccttcttgctgttctatatgatggcggcaaataccgcgattaagaaaaaaatcatttcactggtaagcgcgctggccgtattagcagccgtttcattgtcatggccgctcattgttgacaatattcctgccggcaaaaggccatatgtcggaagcagccagacaaactccgtattggaattggctttcggatataacgggattcagcggctgacggggcaaagttccggcggcggccagggcgggcccgacggaaacgcatcgaaagggatgtcttcttccggcggttcttcacaaatgcaaaaaccggccggccagtcagcaagcggagacaaatcacaaaccggcagtatgacggcacctccatctaacggacaaatgccaagcggcggtcaaggaggccctccaagcggcggagacggcggcaaaggcggtcctggcggaggaaaaagcggtacaggcaccggctcgaaaatgcagtcagggtcaggaatgttcggtacgggaacacccggtccgctgagactcttccaacaagaattatctgatcagatcagctggctcctgccgtttgcgatttttggattggccggtttattgatcgccggggcgagagaaagaagaagattatcagcagaacagaaggaaacgatcttttgggcagcgtggcttgtgccgattgccggattcttcagtgtggcggaatttttccaccattattatctcattatgctggcgcctccgattgctgctcttaccggtgcgggatgggtcgccctcgttcatctgtaccgcaagcaggcgggatggaaaacttggctattgccggccgctattcttgtgactaccggatttgagctgtttatccttaaaaactacaatgatcaaatcggcgcaggctggagcatcggagcaggcgttctcggtgcagtggcggcaatcgccctgttcgtattcaaacagcgccaaaaaccgctcagttactatgtttcacttgcagcccttctcgtcttgatggtgatgccgatttattgggcgagcacaccgcttctgtacggaggcaacagctcattgcctgaaacaggccctcagcttgcgtcagcaggcggaaaaggcatgggaatggataacgcatctgtcaatacaaaactgatcaactatttagagaaacataacgccggagcggattatctatttgctgcaaccgattccaacacagcggcgccttacattataaaaacgaaaaaagcggtcatggcgatcggcggattcagcgggtctgacccggccattacgctgactcaatttaaaaagctcgtaaaagaagggaaagtaaaatacttcttaacatccggaatgggcaaaggcggaaacaacgatattgttgaatgggttgagaaaaccggaaagaaagtatcttcatacaaatggcaatcaagcacagatcagaaaacgaaaaatcatgatgcagctgatacaaaaagcagcaaggccgcgggtaaaaacagccgaatgagcggcgggccgggcggaatgaatcagtcagcttcactatacgaacttcaatctgatgaataggaggaaaaaacatgagcagacatattcaatattcaatagtcgtcccggtttataacgaggaactcgtcattcagacaacctatcagcgcctgaaagaagtcatggatcaaacaaaagagcattatgaattgatctttgtcaatgatgggagcaaagaccgcagtattgagattttaagagagcaaagtctgattgatccgagagtgaaaattattgatttttccagaaacttcggacatcagatcgcgatcacagcgggtatggattatgcagaggggaatgcaatcgccgtcattgacgccgatttgcaggaccctcctgaattaatccttgatatgattgagcagtggaaagaaggctacgatgtggtgtacgccgtcagaacgaaacgaaagggagaaacctttttcaagaaacagacggcttctctgttttaccggctgctgcggagcgtgactgatattgatattccgctcgacaccggggatttccgcctgctggacagaaaagtctgtgatgagatgaaaagattaaaagaaaaaaatccttttgtcagaggactcgtcagctgggtcggctttaagcagactgctgtagaatatgaacgagatgagcggcttgcgggggaaacgaaatacccgcttaaaaaaatgctgaagctttccatggacgggatcacaacgttctctcataaaccgctcaaggcggcaagctatgcgggaatgctcatgtccggagcgggttttctctatatgtttatcgttttatacatgaagctttttacagacagcaccattacgggctggtcctctctgattgtgatacagctgttattcagcggcatcgttctattaatgctcggaatgatcggcgaatatatcggaagaatttatgacgaagcaaaagatcgtccgctctatatcgtgcaaaaagcgtacggtatgaaaaacgaaaagatttatcgggaccagcatatgtcttaacaaacaccctgtccggccagcggacagggtgcttttatgtaaaataaaagccgcgggatgacagaatgtcccgcggctttttttattcatctgcggccggtctgggtgtgcagagagcgcatgatcagtccggttcacgaaaaatttcagtaaaatgcttgcaccaagcgtcattccccaagcagcgttttgctgaggaagctgaatgctcagctgcagcaagatcaggccggtaacgaccagcaaaagtccggtttgtttcatgtgtatgtatcctcctttgtacactgagtcatacggctgatccaggcctaaagtttcatctgtatataaaaaatccaaggcggctgccttggatttttgttaagaagatgtttcttctttttgagtcagtttcatttttttcgtcatttccttgccatttctgataattttcacgtcaacggtgctgccgactttcgtatttttgtagagaatattgcgaagttcgctgcccgtgtcagtttctttcccttttaagctgataatgatgtcttctgcttttaatccggctttggctgcaggtgatccctgcgccacttcacgaatataaacgcctttattcagctgtttgccgaagaggccgagtgtgccttcctgatagttttgcggcacttgttccaagtcgatcatgctcacgccgatataagggcgctccacctgtcctttcgtgagaagctcttcggcaatcggttttacatcgttgctcggaatcgcaaagccgatgccttctacatcattttcactgattttcatgctgttgatgccgatgattttgccttctgtattcaagagcggtccgccgctgtttccgggattgatggcggcatcggtttggatgacgttgatgcttgactcaccggctgacgtagagatcgagacggttctgtttaagccgctcacgatgccctgtgtgacggtgcgggaaaggtcttttccgagcggatcaccgatggcgatgacggattcacccgttctgagagcggatgaactgccgaagcttgccgtttttgttacgtgtttatcactgatttctaatacggccaagtccgtcagcgaatcacggccgacgagtttagctgttacatcggtgccgtcatataatgacactttaagggaagaggcgccttcgaccacgtggttattcgtaatgatatacgctttgccgtttgctttcttaaaaataacgcctgaacccgatcccgtttccgcatcatcacccgatgcattagagtttgaatccgagcttgatccgaatccgaataaatcggaactgctttgctgcttctgcagattggtgattccgacgatcgccggtgaaatgtcttccaccatattcgaaatgctgcttgaatttgccgatgagctgtttgccgatttgccgctgtctgattcaaaagatgtctgcttggcggttaccgatgacgtttcctgagcgggagccggattggaagtatcttgagtctgatggtctccaagcggcgtaaatgtatagatgccgagggcgagccctccgccgatcactccgccgagaagcggtctgaaccagccgaagcttcgttttttcttgtcctcgtccggctcggaatatccggccggctgcgggttttcttttactaaaaggacttcctgttctttttggtctgtccgattttcatcacgatagttatccatcatgttcactccgtttctctatttcatcatagcatgatttgcctattattactgactccatcttaaacaaaaagtgtgggataataatgaaaagattgtgggaaattgtgaaaaagacgaaatcggacggcggcgctttatattgacaatttccatcggatttgaaataataaatgggatattatgttcaatccttcacatgaaaagatataaaaaattctgtcaagctaatgggggaaatctgttagctttttcactttgtcaaatagttaagaaaggagctgtcaaatgaaagaaaaacatcactggatcatttctctgcttgctgtgctggctgtcgggccggggctgatgtcgaataccgctctttcggctgtccaaagccttgtccggcagacggtcggcggggaaaactttgactcttttcatccgattattatcggtaatatggcatttgccttattcgtgccggcggggccgtatttaagaaaaagattcggctcccggcctgtctatatgatttcgatggccgcgggtgtcatcggagcgctgcttgctgctgtgacaaatgatatttatccgctcgccgcgggccgttttttacagggagctgcggcgggcactatgctgatgattatgattccgatgctggtgctttcgtttccgattgaacgccggaattacgccttatttgtgttaatcggcggattttacgggtccgtcattatggggaccgttttaggcacggcggcggcaagcgccggccattggcattggctgttcggcatttttggcctgctgtcttttttcggcctcattttcagttatatgtggctgcgggatgacgctcataaaaatactgaaaaatctccatttgacggcatcggttttctgttagcgggtggatcagccgtgctgaccgcctatacttttattcatctgccgaaatggggcttttcatcatggcagacattggcgggatttggaggaagcatcgtcattctgctgatcctgctgattatgcagtacagaaacgaacatgcgctgatttcgattaaacttatgctgattccaaagccgattttgggtgttttcatgatcgctgcgggcagtatttccatagcggtcagtctttctgcatttcacggggagcttcagaccgcatatcacatgtcacaaactcaactgatattcttatatgcgagccttttgggaggcgtggccatcgccgctgttatcagtgcattagcatatgataaagtcggtccgggcatgctcggcataacaggctctgttatactggtgttcgtgaatttccaatggatgacggcgggtcatcatataccgtttattctatttgcggcgcttttcgtgatgctggcggccgggacagggcttatcgtagcagccggactgatgggcgccgcgttgggcggaccgcttccggaactggtgaaacgcatgacggccgttcagtttttaaggctgttcatttatatgggcgcacctgttttaatagggtattttacgaaaagagatgcttccggcatgcttcggggcgcgcgcggcacacaatcgccgcatgacctgctgatggggacatacagcgatttgtttcttattgctttcatcttaagcttgcttttagtgtgtttatcatttgtcatgaatgcgaccggcatgggacataagctggcgcataaaccgcatgccgtccgtaagcaggcggatgaaaagccttcgccgcaggctcctggaccgatcaggcatcaggtcattcccgatcgcgaatacagaagtgcggtcagacagtttcggggtcaccctataaacaaaaacggtatgtaactttttctatcagcaaacccttttcccggtgaaaagggtttgttttttcccataatggcagaatggtatattgcatgtttcatccttttttaatataatttgttagaatattcataatttaatatcgaaattttaaataaaaaaggaggcattacatgaaactgtatctatctgtggatatggaagggatttccggactgcctgatgaaacatttgtcaattccagcatgcacaattatgagcgcggcagggttctgatgaccgaagaagcaaactggtgcatcgcagaagcgtttaataacggatgcacggaagtgaccgtgaatgacagccactcaaagatgaataatctgctcgcggaaaaacttcaccctgaggcagagctgattacgggggatgtcaagccgttttccatgatgcaggggcttgatgaatcgtattcaggtgtgatgtttatcggctatcatgcgagagcgtcgatgccgggcgtcatgtcgcacagcatgatattcggcgtccgccacttttacataaatgataagcctgtcggtgaactggggttaaatgcctatctcgccggattttacgatgtcccggtcatcatggctgccggagatgattgcgccgcaaaagaggcggaggagctgatcccgaatgtgacgactgccgccgtcaaacaaaccatttcaagaaccgcggtcaaatgcctgtcccctcaaaaagccggacggctcctgacggaaaaaacagcctatgcgctcaaaaataaagataaggtcaaaccgctgactccgcctgaaaaacctgtattaggcattgaatttgccaattacggacaggctgaatgggcccatttaatgccgggcacagaaatcatcccgggaacgacaatcgttcaatttcaggcaaaagacatgccggaagcctatcaggccatgctcgtcatgacagaactcgctatgagaacaacattctgttaaaggggtgaacggcattgctgcggtattttatcaaacgttttatcgccatgattatgaccgtcctcgtcatcaccactctgacatttgtcatgatgaaagtgatacccggctcgccttttaacgaagagcggggcacaaacgaagcggtccagcgaaatcttgaatcctactaccatctgaacgaacctcttatcactcaatacgccatctatctaaaatccattcttacctttgatttcggtccttcaatcaaaaaaccgtcagacagtgtaaacgccatgcttgaacgcggatttcccgtctccttcgagcttgggataacggcgatcatcatcgctgtgatttccggactcgcgctcggcataacggccgctctcaggcgcggcggctttctcgattatgcggccatgagccttgcggtgctcgggatttccattccgaattttataatggctacgctgctgattcagcaatttgcggttcatctgaaatggtttccggcagctacctggacgagtcccgttcacatggttctgccgactgttgcgcttgccgtcggtcccatggccattatcgcgcggctgacaagatcaagcatggccgaagtgctgactcaggattacatccgcacggcaaaagcaaaggggctttctcccgtcaaaattgtgatcaaacacgcattgaaaaacgcacttatgcctgttgtgacagtactcgggacgcttgccgcaagtattttaacgggcagtttcgtcatcgagaaaatttttgccataccgggaatgggcaaatatttcgtagaaagcatcaatcagcgcgattacccggtcatcatgggaacgaccgtattttacagtgtgattctgatcgtcctgctgtttctggttgatttggcatacggcctgttagacccgcgcataaaacttcataagaaagggtgatcctgatgaatctcccgcaagaaacggtaaaacacacagaagtgcctgatgactggtttcagccgggcgcggaaagaaagggtgaaaccgagtcggtcaagcgtccgagcctgtcttacagtcaggatgcgtggcggcggcttaaaaagaacaaattggcgatggccggacttgtgatattatgctgcctgtttctatcggctgtgttcggcccgctgatatcaccgcacagcgtgacaaggcagacgctcgccgagcagaatcttccgccttctttttcacactggttcggaaccgatgaacttggccgggacgtgtttacaagaacgtggtacggagcgaggatctctttatttgtcggtgtgatggcggcgctgatcgactttttgatcggcgttatctacggaggcgtcgcgggctacaaagggggccggacagacagcgccatgatgagaatcatcgaggttctctacggtttgccttatctgctcgttgtcattttgttaatggtgctgatggggccggggctcagttccattatcgtcgctctgacagtgacgggatgggtcggcatggcgcggattgtgagagggcaggtgctgaggatgaagcatgatgaacacgtattggcatcgaaaacgtttggagcgaaaacatttcggatcattaagaaaaatctgctgccgaatacgatgggagccattattgtccaaatgacgctgacggtgccggcggcgatttttgcggaatcatttttaagttttctcggactcggcattcaggcgccgtttgcaagctggggagtcatggcaaatgacgggctgccggcgattttatcaggccattggtggcggctgttttttcccgcttttttcatttccttaacgatgtacgcgtttaacgtgcttggagacggcttgcaggacgcgttagacccgaaactgaggaggtaggaaaaatggcgcagcaagttctttccgttcaaaatctgcatgttactttttcaacatacggaggcactgtaaaagccgtaagaggcgtcagcttcgatttatataaaggtgaaacgtttgcgatcgtcggtgaatcgggatgcggaaaaagcgtgacgtcacaagccgtgatgggtcttcttccgaaacattcggcaaagattgaatccggaagcatacaatttaaacagaaagacctttgccgaatgtcggatcgggaaatgcggggaatccgggggagcgatatttctatgatttttcaggacccgatgacggcgctcaatccgactttgaccataggggatcagctctcagaagcgctgttggaacaccgcgccatgacaagaaaacaagctgaatccgaggttctcgccatgctggatctggtcggtatcccggactcgaaatcccgcctgaagcagtacccccaccaattaagcgggggcatgcggcagcggatcgtgatcgcgatggctctgatctgcgagccggaaattatgatcgccgatgaaccgacaacggctcttgatgtgacaattcaagcacaaatccttgaattatttaagaagattcaaagaaaaacaggcgtgtctattattctgatcacccacgatctcggcgtcgtcgctcagaccgccgacagagtcgccgttatgtatgcggggaaaatcgccgaaatcggcacgaggcatgatattttttaccgtccggctcatccatacacaaaggggctgcttcgttcagtgccgcggctggatatggaagatagtgagctttcgccgattgacgggacgccgcctgatttattcgatccgccgccgggctgcccgtttgccgcccgctgcccggacaggatgatcgtctgtgaaaaggtatacccggcaacaaccgtgaaatccaaaagccgtatcgtcagctgctggcttcaggatcaccgtgcagagcggctgaagcagcagctgactgcagcagaggaaaaagggggattgaaatgaaaaagagatgggcgattggtgtgattgctgttgtttcgtttgctctgatgggctgtacagccaatgaacaggcggggacagaacccggcaaagcaaaagaacaggggggagagacggtgctgcggctcaataacgaaaatgagccgacctcacttgatccgccgatcggatttaataatgtttcctggcagccgctgaataacatcatggaaggattgacgaggctcggaaaagataataagcccgaaccggccatggcggaaagctggaaggtgtccgctgataagctgacatataccttcaatatccgagataacgccgaatggacaaatggcgatcccgtcacggcggaagacttcgtgtacgcctggaagcggatgctcgatccgaaaacgggcgcatcttccgcttttctcggctatatgatcaaaggcggagaagaatttaacagcggaaaaggcaaaaaagaagacgtgaaagtcacggcaaaggataaaaaaacgcttgtcgtcacattggcggccccgcaggattattttttgagcgtcgtgtccaatccggcgtatttcccgattaatgagaaggtcgccaaggctgatgcgaaatggttcactgaagcaaaaacttttgtcggcaacgggccgttcaaactgacggaatggaagcatgacgacagcatgacgatggtcaaaaacgagacgtattgggataaaaagacggtgaaactggataaagtgacatgggcgatggtcagtgaccggaataccgactatcagatgttccagtcgggggatttggataccgcctttgtgccggcagagctgagcgagcagctgatgggaggaaaaaatgtccgcacgtgggatcaggccggactctatttctatcgttttaacgttaaaatggagccgtttcaaaatgaaaagatcagaaaagcgttcgcggcagcgattgatcagaaagaaatcacggattatgtgaccaaaaacagtgaaaagccggcacatgcctttgtatccccgggatttactcagcctgacgggaaagatttccgcgaagcgggcggcagtttactaactccggatgaatcagaagccaaaaaactgctggaaaaaggcatggcagaagagcattatgacaagctgcccgccgttacattgacatacagcacaaaaccggagcataagaaaatagcggaagcgattcagcagaagctcaaaagtgtgctcggtatagacgttaagctcgccaatatggaatggaacgtctttttagaagagcagaaaggactgaagttccagttctctcaaagctcatttttaccggattacgcagatccgatcagttttcttgaggctttccaaacggataattccatgaaccgcaccggctggggaagcgcggcatacgacggctgcatcaagcaggcaaaacaggaagccgatgccaaaaaacgttttgcgctcatgcataaagcggaaaagctgctcatgaacgaggctccgatcattccgatttacttttacaatcaggtgcatctgcagaacagcggcgtgaagggcattgtccggcaccccgtcggttacattgatctgaaatgggcggaaaagtcctgatcttacagcggaaacatatgccgctcttttgccgttaaaggagcggcgtgtttcacttttcaatccggaaaggagattgaaaaagtcatgaaccataaaccgaaagcactgcaaaaaggcgacacggtcggtgtgattgcacccgcaagcccgcctgagagcgggacgctgcaaaccgcgctgctgtttttagagaatgagcttggccttcaagtgaaactcggccgggcgctgaagacccgtcacggctatttggcgggagaagaccgggcgcgcctcaatgatctccatgacatgtttagtgatcagaatgtcaaagcggtgatatgcgcgtgcggaggattcggcacgggccgcattgccgccgacatcgatttcggcttaatccgccgcaatccgaaaattttctggggatacagcgatattacgtttttacataccgccattcatcaaaatacggggctcgtcacatttcacggcccgatgctgagcacggatgtcgggcttgaagatgctgaacccctgacaaaagcgtcgtatcatcagctttttacagaaacggaattcacctatacggaggacatttctccgctggaggtgctgacaggcggaagggccgagggagagcttgcgggcggcaatctgtcgctcattacgtccacactcggcacgccgtttgaaattgatacgaaagacaaattgctgtttatcgaggatattgatgaggagccgtatcaaatcgacaggatgctgaatcaattaaagatggccggaaaactgtcagacgcagccggaatactggtctgtgattttcaccaatgcgaaccgaagcataaagaaaagtcgcttactttagagcaagtgctgaacgattacattgtcaaatcagggaagcccgcgctcaaaggctttaaaatcggccattgttcaccgagcttcgccgttccgatcggagcccgcgcggttatggatacggcggccaaagcggtaacgattgaatcgggggtttccggaagggagtgatcaggcgtgaggattacagatattcaaacgggacggatgtccgtgccgctgaaaaagccgtttaagaccgctttgcgcacggtttacaatgctgaatcggtcattgtgaagctcacatttgacaacggtctgaccggctggggcgaggcgccgccgacggttgtcattacaggcgacagcacggacggtattgaaagcgccgtccgcgatgtgctgaagcccgctctcttggggcggagcctttccggcatagaagctgttttgtatgatatcagccggctgttggaaagaaatcaaagcgcaaaagccgcggtggatatggctgtatatgacggatgggcgcaaatgcacggacagccgctttaccggcttctcggaggctatcggaatacactggaaacagattttaccgtcagcgtcaattctcctgaggagatggcgggggatgcagaccgctatgtgaacaaaggatttcatattttaaagataaaagtcggcataggtgacatatcggacgatgttgcccggattcaggcgatcagatcacgtgtcggcggaaacgtcaaactgagattggacgccaaccaaggctggacgccgaaagaagccgtgactgcgatccgaaagatggaagacgccggcctcggcattgagctggtcgagcagcctgttcataaagacgatatcgccgggctgaagcaggtcaccgatgccgtagacacgccgattatggcggatgagagcgtctttactccccgtcaggccttttgcgtgctgcagacgagaagcgccgatttaatcaatattaagctgatgaaagcgggcggcataaagcaggcggaaacaatcaatgcgatggccgaaacgtgcggcgtggaatgcatggtcggcagcatgattgagaccaagctcggcatcaccgccgcggctcattttgccgcgggcaaacggaatgtgacaaggtttgattttgatgcgccgcttatgctgaaagatgatttgattaaaggcggcatcacatacagcggcagtcagattacgattcccgatgaaccgggtctcggcattaccggggtgtcgaaacaagaggaggcgaaaagatgagagcagccgttacagcggcggcagccaacgtatggacgatgccgtcatctccccgttcgtatgatgcgccgatgcttgaaaacccgccgcagatcagaaaatggttagcgtctatgggatatgaagagcggctgcaattatgcacagacaaccttgtccaaacgcaagcgcttttcggggaagaggtgatcattctcaaagaggaaggggaatgggcttttgtcgccgttcccggccagccctcaaacaaggatgcgcgcggatatccgggctggataaaaaaaagccagctttcaaaagacggctttttttcatcttcgcccgccgtatggattaccaaaccgacagcttttttatatcacactaacggcgaaccggacttggaagtaagtttcttaacgcgtcttccggcatcaggacgtgagaaaggcttttttcgggttgtgacgcctctcggagaacggttcgtaaatgaagctgacgcagacgagtgccggcatacggaaggacgggcggccgaggtcatcgaaacgggcatgatgtttctcgggcttccgtacttatggggaggactgagcggtttcgggtttgactgttccgggtttatgtattcgatatttaaagcaaacggctatacccttccccgtgatgcaaaggaccaagcaaaagccgggtgcggcgcggcggtaaacgatatccggccggctgaccttttgtttttcgcctatgaagaaggaaaaggcgcgattcaccatgtcggtttggcgctgggagacggccgaatgctgcactccccgaaaacgggaaaaacaatcgaagtgctgtccttggaaggaacgatctatgaaaaagaattatgcaccgtacgccgctgtataagcgaaaagggggaatagaaaatgacggcatctccgctccttgaagtcagcgggctgaaaatgcattttgacgcaggaagaaagaaagccgtaaaagcagtcgacggtgtcagctttcacattaaaagaggggaaacattcggacttgtcggagaatcgggatgcggtaaatcgacgctcggaagagttattctccgtctgtatgacccgacggccggttcggtatcatatgaagggacggatatacaccgtgccgcggccgaacagcggtcggtcttcttccgcaagctgcagatgattttccaagacccttacgcctcgttaaatccgcgtctgaccgtaagggaaattattatggagccgatggaaatccacaatctttacaatacaagaaaagcccgtatgatgatggcggatgaactgcttgaagctgtcgggctccatccggatttcggcagccggtatccccacgaattcagcggcggacagaggcaaagaatcgggattgccagagcgctctctctgcatcccgaatttatcgtggcggatgagccgatttccgcgctggatgtgtcggtacaggctcaggtcgtcaacctattaaaaaggcttcagaaagagaaagggctgacatttttatttatcgcccacgatttatcaatggtcaagcatatcagcgaccggatcggcgtgatgtatttgggccgcatgatggaaattacagaaagcgctgcgctttaccgggaaccgcttcacccttatacgaaggcgcttttatcctcaatcccgattcctgatccgcttcttgaggacaagcgtgaacggattattctgaaaggggagctgccgagcccccttaacccgccgagcggctgtgtattcaggacgcggtgccctgaagcgatggagctctgcggtaagataacgcctgagcttgaagaagtgaaggcggggcgttttgtcgcctgccatttatacaaaaaagaaagctgacaatataaagtcagctttctttttgattaaatctgatgcagaaatgacacgcagaccggatacggaaccggaatgtcggattgaagcagagtcaatttgcctgtttccggatcacgttcaaacaaaaccagatttcccgtttcttcgtttgacgcgacaaggaatgtctcggaagggtcaaacgcgaaatcacgcggccagttgccttctgtcggcacccattcaataagagacaattcaccggaatattggttgatcttaaagatggcgatgctgtcatgtccgcggttggcggcataaagaaatctgccgtctttagatatgcggattgcgctgccttgcgatttgtccgtaaagccttcaggcaaagcggaaatgacctgcagctctctgaattcacctaaggtcgggttgtattcaagcgcgatgacttcattgctgatttccgtcatgacataggcgtatttttccgccggatggaaaacgatgtggcgcggccctgaacccggtgcgaaagagtgagttttcacctctgtgagcgaaccgtttttcatttggtacgtatacagcgtatccgtccctaaatcgacggctgcaatgtagttatgctcaggtgtatagccagcgaaatgggtatgcggtttctcttgtctttcatgaggacctgttcccgtatgagcggcttcggcagccggctcctgcagacttccgtcctcattgacgggaaaggcgtgcacttttccgctgtggtaattagcggttaacacatattcatgtttatcatcaatgctgacgtggcatggagacgggccttcaatcagctggtggtttacaaacgttaattccccgctgttctgatgaatctgataggctgcgacgccgccttttccgtctgctttttcaatggaatacagcatgctgttatcagaattcggagtgacgtatgtcgggttgccgagctttgctgccagcttcggccggctgagccttttcgcttctgtatcaagttcaaaacaataaatgccttcgcttccgccttttgtatatgttcccgcgtatcctatgtacttagccattcggtttccccctttagagtcttgtcttctctatattaacgtatcttgaaggaaactgccttgtaaatgtttaagatgttctggcaagcggcaaggtgcagcagcggaaggaaccgcctgatttgataatttcggaaaactcggtttcaatgaccgtataacccctttttctgagctcgcggttcgtatgacggtgctgcggcaggctgataattgtctgattgccgattgacaggatattcgggccgagcgtgaattgctcttcttcaggcacttctatcatctcaaaacgttcggcgagaagatcaatttctttctgccgcaagccatttttacagtatagcgcttccgtttccgagatcatattaaatacacagtccaaatgtaagaaatcctccttgagagggatcggcacaacagtcatctccggcagcgcctcccgcagctcccggacagccgctttatccgtacgcttgctcagcccggcgtaaacggtgccgtctgcgatcaagatgtcgccgccttcaatgttcgcttttttcagtcgcgtataagggattttcttatcgtcaagcaggtcttgaaacactttttcttctccctgccggactgaagccgccatgtttgaaataaacgctgtctcgcctaagacaaatccgatatcccgggtgaatacctgctcaggcaaagcgggatcggcaggcagcaggacgacttcaatctgatgagatcttaaaatgtcaataaactcactatgctgtttgagggcaacgggtatgttaatattttcttgtttgaaatgtttctgcgttccgttaataatatccttgatggtcatgtgttccggccggcataagatgactgtctgcaaagcatcaaactcactgcggcaagccggtttccgcgtggatttgggtatggatacgtccatgtgatatcctcctatcggtattcaatgtgcgtttattattcccggatgtgataaataatgaaacatttctgatagaatatctaaccaacttaatatttaaaattttagacaaaacgatcaaagtattgtttaatagggtacagatgaaatgtcaaaacgaccagacaccaaaggggagtttaaataatatgaagttgccagaatcaagattttgcaaagaaacaagggttgtcaagacaagcagggtttttccgcttgatacgaataatcacaatacgctgtttggcggaaagctgatgagctatattgatgatatcgcttcaatttccgcggcccgccactgccggtgtgaaacagtcacggcctcaatggattctgtggattttttgcgcccgatcggccaacaggattccgtatgtcttgaatcctacgtcacatgggtcggcacatcgtctatggaggtgtttgtcaaagtcattaaagaacatctgatgacgggtgaacgcgagcttgcggcaacgtcgtttctgacattcgtcgcgctcgattcaaacgggaaatcggtgcccgttccgcggatcgtgccggaaaccgaggaagaaatcatgcttcacaatacggccgttcagcgcgccggagaacgaaaaaaccgcttaaaacacagcaaggccctggccgaggcgctcggaacagataaaccttggtaatcgtcaaaccgctttttttaaaagcggtttttttatgctgaaaaaggacttttcctgccgggtccataatttattacagggaaaggagacgtggcgtgcatgatgaaacataagtcttccggcaccatcctgacaaccgggcgtatccgtctgcggactatgcgggatgacgatgaagacaatttgtacgggctgtttaccgacagagaggtcatgaaatattatccttctcttaaaagcagacgggaaacgaaggaatggattgcctggaacaaacgattggccgcaggatacggcgtcagtctttggatcgcagaggataaagtgtcgggtgcatttctcggtcaatgcggaatcgttccgcagacgataagcggaaacactttgatggaaatcggctatatgtttgcccgctgccgctggggctgcggctatgcgacagaggcggcgaacgcctgtctggactacggttttcatacgcagcaatacggacgcatagcggcgctgattgatccggaaaatgctgcctccgtccgcgtcgcggaaaaaatcggcatggtgcccggtgagaccgttaccaaatgggagaggcggctgacggtatttgacatcacatctgacgttgaacgtttcggcgaaatgtagtatgatacgaacagacatgttttctagggttccgcatgttcatacatggcctggtccgagagaaaacacatatgcggacatatcccgcatatgcacacggagggaaaaaagcccgggagagtcaatctcatgtgagacgactattccgggctttttgtattgcccggaaacagaaaggatgaagaacatgaaatggggtttagtggtcatagcggccgtatttgaagtggtatgggtcaccggcctgaaacatgctgattcggcactgacgtggggcggcacgattacgggaatcatcatcagtttttatctattaatcaaggcgacggacagcctgcccgtaggaacggtatatgcggtctttaccggactcgggacagcgggcaccgtgctcagtgaaatcctgcttttcaaagaacaggccgatccggtaaaaatcgtgctgatcggcgttttgctgatcggtgtcatcggattaaagctggtcacacaggataagcctgagacgaaggaggagaaggcgtaatgcattggatcagcctgatagccgcgggtctttgtgaaatgctcggggtcattttaatgaatcaatttcaaaaagaaaagaaagtcaagtggatttttttcattatcgtcggatttgcggcttctttttccctgctttcttatgcgatggagacgattgcgatgggcacggcctatgcgatctggaccggtatcggcacggcgggcggcgcactagccggcattcttttctacggcgagcagaaggatgcgaagcgcatctttttcattgcgcttattttgtgcgcagccgtagggctgaaaattctttcgtaaattgatttttatcaaattttcagtataatctataataagttacgaattatgaagatacgagggattaaaacagatgaattcatatatgacacagcggctgaaagaataccgccgcggtaatgaggaaaaagggcgcctgcttgtcagctgccccgatcagccgggaattgtatcggctgtttccgcgtttttgtttgaacacggcgcaaatattattgaatcaaatcaatatacgactgaccctgaaggcggacgtttttttctcaggatcgaattcgactgcaagggcattcgtgagaaaaaagaggatttacagcaggcgttcgcctcaatcgcccagacattcggcatgacatggagcctctctctggcaagtgagctgaagcgagtggcgatctttgtatccaaagagctgcactgccttcatgaactgatttgggaatggcaaagcggcaatatgatggccgaaattgcggtcgtcatcagcaaccatgaagaggcgaaagaagtggtcgagccgctgaatattccattccattacatgaaagctaacaaagatatccgcgccgaagttgagcggcgccagcttgagctgctggagcagtataagattgatgtgatcgttcttgcccgctacatgcagattttgacgtctgattttgtatctgcccatccgaatcggattattaacatccaccattcatttctgccggcctttatcggcgctaatccgtataaacgggcttatgagcgcggagtgaaattaatcggcgcgacctctcactatgtgacggacgatcttgacgaagggccgattattgaacaggatattgaacgcgtcgatcacagagatcacgcagaggatctgaagaatatcggcagaacgattgagcggagcgtgttggcaagagccgtaaaatggcatctggaagaccgtgtcatcgttcacggaaacaaaacgatcgtatttaattaatgacggtccgccggggaggcgggctgttttttatggatgaaaatgtcttgacaagaacctgttttctttgcataatataaaaaaatcattgagcgttgaagaggatcagtacgcagaactttctgtgacagagagcaaaatggcccgctgaaacattttgccgcatgaaacctgccgaacctgccttggagtcctgaggggaaaactcaggcgcgatacctggcgttacaggaaagcgggacgcgtgaaaaacgcgttcaaacaaggtggtaccacggaaagcccatttcgtccttatttttcaggacggaatgggctttttttattgacgagagccggtttggattgattgccacggaggagaaacgatgaaaaaacaaagaattgttgtgaaaatcgggagcagctcgctcaccaacagtaacggaagtattgatgaagcaaaaatcaaggaacatacggaagccatttctttattaaaagaaaacgggcatgaagtgatcctcattacctcaggcgcggtggcagcgggtttttccgctctcggctatccgtcgcgacccgttacgataaaaggaaaacaggcagctgccgcagtcggccagacgcttttaatgcagcaatatatggaccatttaaaaggatacggtctgacgccggcacaaattttattaacaagaaatgatttctcaaaaagagagcggtacagaaatgcctatgccactgtaatggaactgttggagcgcggcgtcgtgccgattattaatgagaatgattccacatcagtcgaagagctgacgttcggtgataacgacatgctgtcggcgcttgtaagcggtttgattcatgcagaccaattaatgattctcacagacattaacgggctgtacgatgccaatccgaatgaaaacccggacgcaaagcggtttgactatctgaatgacatcacacctgaattgctcggatatgccgggtcagcaggctcaaaggtcggcaccggaggcatgaagtcaaaacttctcgccgcccagaccgcattgtcgctcggggtgaaggtgtttatcggaaccggctccggacgtgaaaaactgatggtgattttaaacggaaaaggcgacggcacttatatcggcgataaagacctgtcctcagtgaataatacacggcaatggatcatgtttcattctccgatatcaggggaaatcatcattgatgggggagcggagcaggcgatgatccataacgggtcaagtctcctcccggccggcgtcgccgatgtctgcggcagttttccgaaaggagccgtagtggaagtcagagggcccggcggcattatcggcaaagggcagacacagtactcatccgatgaaattttagaagccaaagggaagcggagcgaccagctttcaggaacgaagcaggtggaagtgattcacagagatgattgggtgaatttatttgacaagggggaacacaaatgagtgaagtattgcaaaaagcggctttggcaaaagaagcggctgccgaaatggtcatgaaaacgacggctgaaaaaaacgaagcgctccaatgtattgcagacggactcagaaatgaacggcagctgattttaacagagaatcagaaagatattgaagcgggacggaacagaggattgacacctgacattattgacaggctgacgcttgatgaaaaacgcctgctcgatatcgcggacgccgtggaactgctaatcggtcttgaagatcccgtcggtgaatcattggagaccattaaaaaagagaatggattatcaattgaaaagatccgcgtgcccctcggagtagtgggcatgatctatgaggccagaccgaacgttaccgtagacgcggccacactctgtctgaaaaccggaaacgcggttgtgctcagaggaagttcttccgccatccacagcaacatagcgcttgtcagtgtgatgaaacgcgcacttgggctgtcaaagcttccgattgatgccgttcagctcatcgaagatacaagcaaagaaaccgccaaacagctctttacattaaatgatgggctggatgtattgatcccgcgcggcggtaaaaatttaattgatcttgtggtcagggaatcaaccgtacccgttttagaaaccggagcgggcaattgccacgtgtacatagatgagtcagcagatccccttatggcaagcgaggtcgtcatcaacgccaaaacacagcgtccttcggtctgcaatgcgattgaatctcttctgattcatgaaaaatgggccgaagaacacggacgaaagctgctgaatcagctgacagaaaaaggggtggagctccgaggagaccaggtgatttgcggactggagcctcaagcgaaacaagcagaagaagccgattggggagcggagtacctggcgcctattctcagtgtaaaaacggtgcaggacgtacaggaggcggtccgccacattcagcagtacggcacaaaccattcagaagccattctgacggagaacgccgagcatgcggcttacttccagaccgccgttgacgccgccgccgtgtatcataatgcttcaacccggtttacggacggttttgaattcggatacggagccgagatcggcatcagcacgcaaaagcttcacgcgagagggccgatgggacttccggcgttaacatctacaaaaatcatcatcaaaggaaacggacaaatccgggtataatcttttaagcttatccttcaaaaagggtaagctttttttatgcggaaagattgacggtttccattatatttcgtaaaattaaattgtacacaatataatagaggtgaatttatatgacaaaaccattatttactgcaaccgtttcagccgcaggcggacgtgaagggaaagtcacgtcttctgacggggtgctgaatcttgatgttgccatgccgggaacgccaagagcaaaaaagctcgaacaagccacaaaccctgaacagctgtttgccgcaggatattcagcctgctttgacagcgctcttcaactcgtagcaagaaaagagcgtctgagtattgaaacagaggtcactgcgcatgtcagtctgctgaaagatgaaagcgaccaaggatataaactcggcgttacccttgaggtcaaagcatccggcattgagaaacaggagcttgaagcccttatccaaaaagcgcacggtgtgtgcccgtattcaaaagcgacagcgggaaatattgaagtgaagcttctggcagcagaataaaaataaggatgcccattcggggcatccttattttttgccgtgcagcgttttcaaaacctcataaagcgactgttttacctgctttaattcctcttttgacagtcccgtctgttccagcatggcaatggggatatctgccgctgtattctgcaaggcccgtccttcatctgtgagcctgatcgtcacggatcgctcgtcttcagccgaccgctttctcatgatgattccgtgctgctccatccgtttcagcatcggtgtcagcgttccggaatccaggtgcaaaagctcacccatccgtttcacattcagttcttcgtgctcccataataaaagcagcgccaaatactggggataagttacgttgagcttatcaagcagcggtttgtaccgtttcgtcatttcccttgagcttgcgtacagcaaaaaacaaagctgattctccagtttcatatgttcaaaatctttttctgccattctttcaccaactcttttttgttaacgttacccctattgtagccgaaaaacggcccatttcctattgcaatcatgtttaaaaatatgagcaggggcaatatatacagtaagtacaatgaggaggctgataataatggcattatttacttcaaaagcgaccgcagtcggcggacgagcaggacatattaaatccgaagacggggtgctggattttgacatcatcatgccgaatgcaaaaaaagacggagaaaccggcacaaaccctgaacagctctttgcggcaggatatgctgcctgcttcgggggagcgcttgaactcgccgcccaaaaacaaaaaatcgacatgacctctgaaattgaaggacaggtcagccttttaaaagatgagagtgacgggggttacaaaatcggcgtaacgctcgtcattgatacaaaagatcttgataaagaaacggcggagaagctggtgcacgccgctcacgagttctgtccgtattcaaaagcaacaagaggaaatgtagacgtcaaacttgaattgaaataaagaaacgaacgaatatcccggatttcatatccgggatattttattaacgaaaacatcagtaatgatctcttctctcccggaataagaatacgatatagcacttttgcataatgacaccaagagaaaagagggagaaatcgatgactcttccaaacataccgaacatcacccccgacattacactctccagatgtgagaccctgaacctccttctttcatccgtggctatggaagaaatcggactatcccatattctgcaggcggaagcggaaaggattcaaatgtttctcagcgcttccggcgatccctccttaggggaattatcatcaatcaatagaagcactgaacggctcctgcgcaccgtcatgaaatcacaactccttttgcagacgaagcttgaagacattatctacttacaggatgctgaagcctgtatagacccggacgatccaagtaatccgagtgatccaggcgatcctgatgacccgtggaatccggacgacccaagtaatccgagtgatcccggtgatcctgatgacccgtggaatccggacgacccaagtaatccgagtgatccgggcgatcctgatgacccgtggaatccggacgatcccagtgatccggaagatccgtgtgacgacctgttttacggccgtattggctgctgtgagtgcggggattgtgaggactgcgattggaagaaaaaaggcggggagcgttcataaaaaaagagacgggtgaagcatatgccgtatccgagcatctcaaaagcgaaacagacatcttttgaagccttgcattgtctcacgatggcgctgttaaatatattatctgtgaccgtggataaaagaaggggttcaaattacaaagaagaaatcaggctgttctccgcattgtgccgctggcagatggaaacgggcggccggctgtttttaatgatcagcttggaagaagaacagaagcagatgtatgcgcggcactttcatgaaatgaagacagtgacggaacgaacgaaaaaattcatttgtgaaagcccgcgcgaattccgggcgcatcccattacgaagcgggctgtcaggcagcttcaggaatgggatgcagaatcaactgccgaacctgccgtcagatgggtgcggcctgtcatcataacgatgaacggcactcctggacggccttggttcaatcaacaactccaaaatcgggaaaggtgagaaaatgagcggaaatgctgaatgtaaactgactctttgcatgattgtgaaaaacgaggagagatatatctcccgttgtttatcaagtgtacaagacatcgctgatgagatcgtcatcgcagacaccggatcacaagataatacaaaagatatatgtaaaagctttcaggcaagagtgtttgatttcgaatgggagaatgatttcgcaaaggccagaaattacgccctgcagcatgccgaaggggattggattttagtgcttgacgcggatgaagagctcgatcaggagacgggccgttttttaacttctctgcttcatgacggattaccgagccggggacttttgaaaatcatcaattatacggggaagcagctcgatgaaaacgaagcgtttgaaagcatgcagccgaggctgttccgcaatcataaaggccttctgtatcaaggcagaattcacgagaatatctcggctcccaatgaggaagaaaacaatgcttttttcacgctcccatgtgtgattcatcactacggctacttggagcaggaagaaaaaatcaaacaaaaacataaacggaatatcagcatattaaatgaagaactttcagaggaaaatcctgatccgtggctagtctatcatctggcaagtgaatgttacagaataaaagactatgaaaaagcattacatcttgtcaacggctcaatatttcaatttttaagtgagaaacgaatgcctccgtctcttctgtattttctaaaatatacaatattgcttgagctcaagcgatatgaagaagccgaacaagggattgaaaaagtgctcaagctttatcctgattacagcaatcttcattattataaaggccttgtattatatcatttggaaaagtacagagcggcaatcaaagcatttgaagccggaacgcaggttgaaggagaaaacgctgatcacttcattttaaaaggtgccgccgatttcagagctttttattatatggcgaaatgccatgctgcattaaaccatgatatgacggccatcgcttacgccaaaaaatccgtgaaattcaatccgcaatttaaacccgcgcaagaacttctgtctcaattaaaaaaggatcagcggacaaacgcctgatcctttttttgcatgttccattaagataatcgaataatgtttaaagctgcgccggcacttcctctaagcaatgtggccgcacccaataatccgaacagctggagctgaatggtgctgcctgctgtcaaagtcacaataaaggagttattgaagtttgccaaagacgcgaccggagcaataatcgaacttgcagccggagtgccgttgattaagatgcgcgaacttactagcaggccggccgttaaattaatatggtaggaaatatagtaccgtcctgccggagcaacggtgaatacagtatttgcggcattagcggtaatatccgctgagaggttttgttcattcggtaaggaaatggccgtgccgccgttaataactgcgacaacaccgccgcccgtattgctcgcatagccggaagtggctgtcagacttgttccggtgcttcccggaggccctgtaatgccggtagccccggtaactccggtcggtcctgtaacgccggtaattccagttgatccagtgccgccagtagccccggtaattccggtccgcccggttgaaccagtagcgccggtgcttcccgccgcagctaaaagtgtatagtcagctgaggtttcaggggttcccgacgggctgtttacgtttgcgacataagagctgccgttatacaagacaacctgtccggtcgtgtaagtaggggcgatcagcggattaaaagcaacaatcccttgaagacccgcacccgtggccccgtcggccccgtggcccccgtcggtcccgccaatgtagggatatttgagatactgtccaattttgaaccgagaaggagctcctgtttcattaagctgtcaagcgtatcccggacgctctcattcaggttaagaatatccgcaagacttgacgggggtcctgttaatccgggaatcgttccgagcgcgtattggattttttccccttccgcattcagaatatgtgccattcccagctcttccatagcaattgacgaaagaagaaggttaatggtatcgtctctggaaagtgtaacgacaggggtgatattgggcatattaggctgtgacacaatgtccctccttatgagttggctgaaaatcattttattgcgaacaaagttcccccaaatgagcgtaagcagtactgtatcattatattcactgattctgtccaagtttctgaacgaattcccttcattaatttcatcatatatgaaggaaatactttaaatatagagaaaatacatcgcacagcattcacaaaatcggtcaaaatgacagcgggacatgtgatcgtctataaagcgatggctatatatcttgtgcgtttcctgcaaaaacgctctttttcatttcaagttttctgtataaaagggcgagaagcatggacggtatcgtacaaacaatcattccgataaaggcataccggggttcaatttcatataaaaaacctccgaaaatagtaaataccgcagtgctccagctgagagcaagcgctgaatatataccttgggctttcgggatttgcgcgggtgaaatatttttaattaagtatttcataaatgcatagtgtcccatcgcgaatgaacaggcatgcagcgtctgcgcaagacagaaaatgatgacatgcggaaaggcaaatacgagtatccagcgtacggtagcaccaagcgccgccagggcgagcaaagagcctgccgtaaattgatgaaagtatcggtcagcgattgcaaagaagataatctccgtgataacggcgatgttgatgatgattccgatggcatatgcgggcgcatcgatttcctgcaaaaagagataaccgtaattgtagtaagatgcatgtgccgcctgcagtaagataacgattgcgagcaccagaccgaaatatttgatgcggaataaggcaaacatgccctcttttcttgcacggtctgtttccggccgttttgaaagaacagctggcgcatgcataaagcttagggatgcgaatatcagggcgcccaaaagcagtgcccataaaatcgcttgatctccgaatatacctgtaaagacggacaggatgacgccggctgaaacaaaacccgcggatccccactgtcggctagtcccataagcctttaattcgttatgctgtacaaggacgccgcaagcgctgtctaaagcaggcattaaagccgggtaaaacacatgcagcactaatgtgacaagaagcaggctttgaaaagaatcagccggaatataacataaaagtgcgagaagcgtcccgattctggcgccgtttaataaggctttgctgctgaattttcctgataaataagggaagaaaaataatgtggaaatccctcttgccgccaggcccagactcataatgaaactggcttcggatacggaaaccccttttatatgcaccatccatcccgtccaatagggcagaaaaacaccccatgtcataaaaaaactaaaaaaatgcagactcatccagcgatatgctttcattcccgttcctcctttaattggcatgttatcatgtaaggacataaagacaatatgagatatctcatatttttggggtggacgatggaaatttataaaggcgagaaaaagcggcatcagttagaaaaacactcaatcgcgcatttattctctttccccgctgaagagtttatggaagtgcgcgaatatgagcgggacgaatggattattcaagagggcaggaggccagacttcctgttttacgtgattgaaggaaaagcgaaaatatatgtaacccaccaaaacgggaaagtttctttaattaattttatcaacaaaaatgattacatcggagagatggaactattacatgaagtgtattacacaaaaggaattcaagcctcagcgaagactgtttgttttgttctgcctatttaccgctgccgcgtgcaattgctgcaggatgcgaaattcctgcgtgagctggctaagtttttaagtgctaaggcaacgcttatggcttcgaaatattcacaaagtctggcgttcccgcttgaaaaccggcttgctgattttattttgcagacggcttataaaggggtttataaagagaagcacgtaacggtctgtgattatttgggtgtatcttaccgtcatctcttgcatgtgctgacgcaattctgccaaaaagggtatttgcaaaaagaggggcggggctatcaaattaagcagtatgattcattgtatgaactggcagaagcgctgcagaataagtagcatgcccagaaaaaacagccacccgcaatttacggatggctgttttcattatacaagctgagcttgtttttttcgtgcctgtttcgcggcgtcgaccatattttttaatgccgcaacggtttcttcctgctgtcttgttttcagtccgcagtccgggtttacccagaagcggtcagtcggacacacctcaagcgcgtcatcaataatttgatagatttcttcagttgccggcacacgcgggctgtgaatgtcgtatacaccgagtccgaggcctttcacgtaaggatgttctttcaggtactctaaaaatcctccgtggcttctgctgtgttcgattgtaatgacatccgcgtcaagatcattgatcgtatctacgatatcttcaaagttgctgtaacacatatgcgtatgaatctgcgtctcattttgcacagaagacgtcgttaaccggaatgcttctgcggcccaagttaaatattcatcccaatcctgcgtttttaacggcagtccttcgcggagcgcgggttcatccacttggataatctgaataccggcatcttcaagcgcttttacttcttttctgagggcaagcccgatctggaaggcgatttcttttcttgaaatatccacacgcgggaatgaccagtttaagatggtgacaggtcccgtcagcatgcctttcatatgtttttccgtcagcgattgggcgtagaccgtatcttttaccgtcatcggttcgataaattcgacatctccgaaaatgacaggcggacgtacgcagcgtgaaccgtaagactggacccatgcatatttcgtaaaggcgaatccggccagcttttcaccgaagtattccaccatgtccgtccgctcaaattctccgtgaacgagcacgtctaagccgatttcttcctgaatgtcaacccagcgcttcgtttccgcattaataaaggcttggtactgttcatccgtccaatcttttttccgccatttttgccgtgcgctccgcacctcggcagattgagggaagcttccgattgtcgtcgtcggcagaaggggaagaccgagtgattcattctgcagcgccaatcgttcttcaaagcttgccggacgggagaaatctttttccgtcagctgattcagctcttctttttgagcggagttcgctcctgttgcgaatgcttttaaagccttaagtgccgattttgattcttcgatctgctcactgacggccgctttgccggacagaagcccttcttttaagacgccgagttccgccagtttttctttagcgtatgacaggccgttcagcaaatccttttcaagatgctcgtcagggtgtttcgccaccggcacgtgcagaaggctgcttgaaggctgaatccataactcctcaacatcagcgtggctgaggatatccaaagccgcatcaaggcgttcttctacatcgattttccaaatgttccggccgtcgaccacaccggctgccagcactttatctttcgggaagccgtgctttttcaattgctcaaggtttctgcctttatcatgcacgaaatcaagtccgattccctgtacgggataagaaacgagttcttcatatgcatcaactgaatcaaagtatgtctgcaggaggacattcagtcctgaaagctcttttgtaatagattcatagaggtcttttgcggcgcggacatcttcagaagaagctgtcacaagggcaggctcatcaatctgaacccatttgacgccttctgcttcaagctctttcagcagctgcacataaagaggaacaaggcgtttttgaatcgctttcgcttctgattcttcgtatcctttcgcaagcgtgacgaatgtatacggaccgacgatgacaggtttcgtttccgctccgaattcttctttgatccggcggtagtcgtcaagctgtttgtttctcgtcagacggaattcaatgctttcgtcatattcaggaacgatgtaatggtagttggtattgaaccatttcgtcatttcactggaaacggcgtcttttacaccgcgggcaatcgcaaagtatgtatcaacgggatccgtgatgctgcggaatctttccggaatccagttaaagctgacggcggtatcaagcacatgatcataatgagtgaaatcagagaccggcacgatatcgatatgttggtcaagctgtgttttgacagctgataagaataaaccgtcaagctctttaagaaacgtttctttatcagtgtttcctttccaataagcctcaagtgcttttttccattctctgttcaagccgattctcggaaaaccgaggttcgaagttttgattgttgtcattaagtctcctcctttaagtgagatgtaacaaaaaagcctctttctcatgagagaaagaggctttaacttcaaaatgcaagcctctcttatctctcagatcacgtctgatggaattagcaccgtgccttatgagacaatcgtctcggcgcaaaaatcacgcgccccatttcacaatggaattacggtcggttgctgttggggtcaaaaggccaatccctcgcccaactctcgataagagaaagtatttcaatttttttgaaaagttacatcatttgttggttatcttatcagcttattcagatcactgtcaatagaaaatctcacaatttaaaaattggtgatgtgacaaactgatcaatcattatacgagaaaaatatcagaaagacagcagctgtgcctgttcggctctttccatcagcacttcaggcgcgtctaaatacagaaatccgttcccggccaatgttttggcgatgtccaaaggaagggtccgccgcacgagctgggcgtagacttcagcctcagaaagcgtccgctgaaacgcgtcctgttcaagcccttttattaaggcaagcgcaccgctcacatgcggggcggccattgaagtgcccgtcagcttcccgtatttatggttgggaagggtggagagaatattttctcccggagccaccaggtcaatctctttattagcgtttgaaaattcagacgatttacgggcgattgagactgatccgactgcgatcacttcgttgtaagcggccggatacgacagttcctctgtacgctcgtctccgtcgccttcgtttcctgccgcgcaaacgaccagaacaccgctttttaccgcatttgtgaccgcttctttcagttcaggcacatcgcttggcccgccgagtgacatggaaataatgtccgccttttgttcaacggcgtagttgatgccgttaatgatccattcgtatttgccgctgccgtttttcccgccgagaactttaacgattaaaaggcttgcttccggcgcgacacccgaaattccgccgtttgaatcattggctgcaatcgttccggaaacgtgtgtcccgtgtccgttgtaatcggaaatcacgtcttctttgcctccgtcatcatcggtgaagtttttcccgccgacaatccggtctttcaaatcaggatgattgatgtcgcagcctgtgtcaaggaccgcgattttaatatccttgcctttaaacccttttgcccacaactctggcgccttaatcactttaatcccctcaggaagctcgttcacatccatgatctgttcatccgtgacataaggaatcaaatgcatttcaccattcataaaaaagccctccttttttatgcttgccagtggatacaagggtgttgctactattttatggcagagcatgccggccggaaagagtcatttgaagcattttcataaaaaaggcgtaatctatcggactaaaaaatttcaaataaatggatagtttgacagctttcattttcattcatgacccgctgacgctataattggaaatgggaaaggagaagagagatgaagataaatgaagcgttatacagctatttttcagaacaagtggatcaaattgcgaaagagtggatcgaaacgatggaagattcggatccgaattcgatttattctttgacaaatcccgtcatcacagaagaactgacggagcaggataaagaattttaccggcatattaataaaatgtatatcatgccggaaaaagaatttttagaagaattcgagcggtgggtgattgagcttgcgaaagaccagaagcatctggatactcccgtccagtatgtggtccgtgaattcatgagaaaccggagactatacatcagttattatgatgcgtttgccgataaacatgaatcttcgtttgccgagggagaaaggaagaaatgggagaatttaattgcacaagtatttgattttacgatttacacgtttgtcgatcatgctgagcataactcaaaaatgcagctgaatgcgcaaagagaaatgattttggagttaagctcgccggttatcacgctgagcaaacggacggcgctgctgccgcttgtcggcgatattgacacggagcgcgccaaattcattcttgaaaatacgctgagcacatgtgcaaaacggctgattgaacatctgttaattgacctgtcgggtgtagtggttgtcgatacgatggtggcgcatcagatttttaaattaattgaagcgctgaaattgatcggcgtcacgtccactttatccggaatcaggccggaaattgctcaaaccgccgtacagctcggcattaatttctcagagattacggtcaagtccaatctcgctcaggctctcaattatcatcaataacatacataacaaaacaggctgccgaatcactccggcggcctgtttttatacaaacaacaatgaaatgagccagcttgcgccgaataacagaagcacgagcaggaaaaagcaccagtcggcgcggcgcacagtaacagttctgtaaaacgtgcggtttcggctcccagtaaagcctttagattccatcgcgatggccgtgcgttccgcctttctgattgcgcctgccaatagcggaatggtgaagcgcctgaaggcggagagctttcctttcagcccggaatcagacgccgcacccctgattctgtgcgcctgccggatgatcaggatttcatctttcagaagagggagaaaccggaatcccgcgataacgccgtatgcaagcttgggcggcagcttacactgctgaatcagactgagcatgaacagaatcggatcggttgtaaaaagaaacatcatcgacaaagcggaaaaacataaaatacgaaacgcgatagaaatcccgagcgccgcgttatcactgttgacggcaatcggcccgagtttaaacagcagattgctcccggttgtcgggacgtttccgaatacggcggctgtccataaagaaccgaaggccagaatgacaaacggaatcgtgaacagcagccattttttcagcggcacacgccccgccgagaggacgcctcccgcaatgatgatataaaacaaagcaggggtgtacggattataaataaatgacagcataatgacgcataacaatacagccgccgcctttattgacgggttaacagcctccagccgcaagttcatttttccgcctcctgtcgtgtttcatccattcataccgcaggggcaaagctaaatgcgcccgctccgcgattccgatatgatcagaaaacaatgagtcgggcgttccgcggtacaccagcttcgtgccgcagagcacaaggatcgtgtcggcataatccgagacgagttccatatcgtgtgtcaccatcaaaacagccgttccttccttttgaatctcacggagcatttgcatacactcccgcgccgttttggcatcctgtccgaaagtcggttcatcaagcatcaaaacgttcacattgtgcataagcatcgtcgcgacgctgagcctgcgtttttgtccttggcttaaagaaaacggatgctgtgaggcatggcgtctcatgccgaatcgggttaacagctgaagagctttctcctttgcggctctgttgctttcaaaaccgaacatcagctcttgaatgacggaatctgtgacaaactggtgttcaggattctggaaaacatatccgatctgtcgccgcagctctttttcagaataggaatcaatcggtctgccgtctattttgatgtctccgcccagcggacggatgagcttggccgcggcagaaaggagcgtggattttcctgttccgttaggaccggcaatcgcggtgattgaacctttttttacggaaaagctcacatcctgaaaaatgacttctgctcctcttgagaatgacagttcgtgaacgctcagcgcgtcttctgccgaaagcgcggcgggccggggttcgggcagagatggtacaggttcgtgaaacagattttctttacacaatgtaaaaggaatgctgacgtgctcctgcaatgagatcacacgcggaatcggaatgccgagctgtatcagctcttcaatccttgtttcaaagataacatccgtctctccgtccatcaccttctgacccgtttcgtcaaggacaatcgtcctgtccatccacggcgcccagtgatcaagctgatgttcgataacgagaaggccgaagcctttttttgcttgaagatctttgatcagccgcactaattcacgtgccgaatatggatcaagctgtgccgtcggttcgtccaaaataatgagttccggttccatcgcaatgatacaggcaagcgccactttttgttttgaaccgcctgacagcgaagcgatcgttcgcgttttcagatgagtgatctctaatttttctaaaacgtcatcgatgattgcgtccatatcttcttttgtatattgcaaattttccaggccgaaggcgatttcatcttcaacggtcagcatgcaaaactgctggtccggatcttgaaacacgacgccgatagatctggcggcgggttctgtcaggtgtgaaagaggtgttccgtataaagaaacggttcccgattgaaccccatcgcatgcttccgggtacagaccgtttaaacagagagcgagcgagcttttgccgcatccgctcggcccgagcaataaagcccgctctcctttgcggagctgaaaggacacgttttgaaaaatcggcttttcatcctgatcataagaaaaggtaagacggccggcggatagaaggggttcagatgcctgcatcttggttcacctgtttctttttcttcttgaattgttttccgagcgccatgccgttcagcactcctgtgtaagccagcgcatcactgattgctttgccgagaaggccggcaagaagcgcacctgagaccagacggatgagaagcatgacggctaataaacccggattcaaaacagagtatccggaaacgaacaagtcataaatgaagcttgtcacagaagaccccataccggataaaagaagcacgggcagggtatacacccgccagcgtgtcgctaaaaagattgcttccgcaccgattccctgtgcgatcccgatcagaatcaccatcggtcctgacggatttccgagtaagcactccacaaacgcggcgatgatttcagaaacgagagccgctcccggtttttgaataatgtacgcggcaatcaccgagacgataaaccagataccgtaaatcggttcgtagctcatccggccgaaaaatcctgccgctatattgcttgcatgagttgatactaaataaatgacagcaaatacaacactgatgacggacatgacgacaatttctctcattttccaatttttcattgtgatctcctgctttcttatcgatagtcgtaagtatgaaagagttgattttacgaaagacgattgatcgtaagtttcatattgcggtgtcctcccccgttttttaatgaaaaataaaaaactgcatatccgagggaatatgcagcagcagaacgaaaacgcatggggaaaaaccctgcgctccggtcaatctgcacttccccacgctggtattatccagatcgggttataagggatcaaaacacgcctgccgcatgttttatctcagccgataacagcacccctagtgcgtttcctatacagttttttataatgacatcatcatagttgatcatgtctgatttgtaaacagcctttctccgaacagagtttggaatcggaccggaagatcattcataaagataagaagagcccttttgatcaaaaggaaacggaggacatctatgtttgttcatacagtgcagtctggagactcgttattttccatcagcagaaagtacggataccctgttgacagcatcagaagcgtcaacgggcttgaggaaacgaatatcgttccggggcaggcgcttttaatccctcttaatgaatatacggttcagccgaatgatacgtatgccgttatcgcaggtaaggcttatgtgccgcagatgcagctgatgcaggcaaacccggatattccgccgaaccggctgcggacgggtatgaaagtgaagatccctgatatctctaactatcttgcgggaaccctgcaattttatgtcattcggacgcctgaagcggatagagagctgattaatgattttgcgccgtattcttcggcgatttctttgtttgaatatcatttcggcccgaatggagatatcatgaacgatttaaacgacagaaccgcaatagaaaccacatggcagaacagagtgcgcccgcttgccgtcattacgaatctgacagaagggggattcagtccggaattagcccatcaagtgctgcagaatccggcggcaagaacgaatctcgtcaacaatatcgtctccttaacggtaagaaagggatacggcggtgtaaatatcgattttgaacgggtcagagaagctgacagggatctcttcacaggatttctccggcagttaaaaacccggctttcagagcatcagctcgcgttaacgatatcggttccggcgaaaacaagtgatgcagtgccgtggctgaggggatatgattacggcggaatcggagccgtcgtcgattatatgttcattatggcgtacgactggcaccacgccggcagtgagccgggacccgtggcgcctttaacagaggtcaggcaaacgatcaattttgccatcagcagggtgccgagaagaaaagtgattctcggtgttccgctgtacgggtatgattgggtgattccgtaccgtcccggaacgatcggatctgccatctccaatcagcgcgccatggaaacggcgatgaagcatcaatcaatgatccgttattcccagcaggagcgttccccttacttccggtatactgatgaaaatggaagaacgcatgaagtgtggtttgaggatgtgcggagcatgagtgaaaaaatggttctcgttcgggagttcggactgcaggcgatcggcgcgtggcaattaacgctcggtttcaaaccgggcccgtggctgcttaggaacttttttacgatccgaaaaatatagctgcatgtcccgttccgcaagtgattttttctttcctatgataacggagcttcttttggacaatctaaaattgagaaggaggtctgtcatatgaagaaaagggaagagcagtatatcaacgaggctgagtatgtaccgcatccgacaaaagaaggggaatacgcgctcatgctgcatgaatcctatcatttcctttcagaagacgatgaaagcgatttgccggaataagggctttatgcctttattccgtttattttataggcatgtgctgaaatcacaaatttaaggttgacacattccttttttttctgtaatctcagtgtgtcaattcaaataagaacttcgttaggtgaggctcctgtatggagatacgctgctgcccaaaaatgtccaaagacgccaatgggtcaacaggaatcatcgacataaggtgattcttaacgcagctggatggctgtcctatgccatacagtgctaaagctctacgattggaggccccgcacgtttatttgccgtgcttgttttcgccttcatatcggaaggttttttttatgcctcaaaacgtacacgactgagcatgataaggaggtgcggagtatggattctccccattcgagtatgtcagaagaagtacccatatacagccagataaccagtgacgacatgatgaggagacaaaccgccgcacttcccttgacggacggcgcgtctccgtaaaggaggtacgagtcccgatggtccaaaacatgacctatgacgaactcatattacgcattatcattttattgcgggacggaaaaataaaagaattccgaaacatgatagatgagcttcagccctatgacatggcatttttatttaaagaaatgccggaaaagcaccgggcccgctatctgtcatatatgacggttgatgacatcaccgacatgatcggagagctggagcgggaatttcagcttgccgttttgcataaggtcggtaaaacgaaagccactctcgcaatgaataaaatggataacgacgatctcgccgcattgcttgaagagatggatgaagaactgaaagaacagcttttatccagtatggaggctgaggaatcaaaggccgtacagcttttgatgaactatccgcaagaatcggcgggccggatgatgacgaaccgcttcgtctggattccgcagcattatacagtaaaagatgcggtcgtgaagctgaaaagctttgcagaaatcgcagaatcaataaattatttgtacgtgattaatgacagcaagcagcttgtcggagtgctctcttacagagatttaattctcggcgagcctgacgataaagtgcaggatctcatgtttacgcgtgtcatctcggccggggtgctccaagaccaggaagaagtcgcccggctgatccagcggtatgactttttagccattcccatcgtggaagaaaataatgtgcttgtcggtattgtcactgtcgatgatattattgacgtcgtgattaaagaagccgatgaagattacgaaaaattcgcagcctccggtaaggcgattacatttgatacgaaagcatacgtggcggcgtaccgccgtttgccgtggctcattctgcttttgtttatcggattgatttccggaagcattctgaattattttgaagatacattgcaaaaagtagtcgccctcgcgtttttcatgccgatgatcgcgggaacgacgggtaatacaggcacacagtcacttgccgtcgtcatcagaggactggctaaagaagaaatgaataaaaaaaccatctttaaactgattttccgtgaattaagaaccggtatctacatcggcatcgtctgtgcgatcgcgattacgatcgtcgcaaccgtctggcagaaagacttaacgctcggttttgtcgtcggttcatcgctgcttgcaacgttgattatcggtacgatggccggaacgatcgtccctattattcttcataaactgaacattgacccggcgattgcgtcaggaccgctgattacgacgctgaacgatattttgtccttattaatttatttcggcattgcaactgcatttcttcatgctttataaaaaaagtccgtctcacaggaggcggacttttttgatcagcggtttttatacttaaaatgagcattaagctgtccttccagcatttttttgcggagctgcgggtcgtttttgagagcctgttcttttttccgcatgtcttttaaaatctcagccgtctgcacgccgtcttcccgcttgttggcaatatccatcagccgctcaacgtccgcgaaggaatactttctcgttccccgtgatgatcgctgcgggtagattaatttccgttcttcatagtatctgatctgtctgactgacaatccggttaattcgcttacaatgccgatcgagattacttttttatctttgtaagattgttcgtctgtcgtcatttttccacccctggatgtcttttactcatattatataagaaaaaaagagaaaaaacctgacgcttgtcaggttttctgacgcggaatagaaaattttagaaaaaaagcggcagaaaaattgacaaggttaatgcatggttctgtgcccccgttttatgcttattgtacagatacaatgaggaggaaggataggaatggagaaagaaaaagcggtttcgctggcaaaagaaatcattgaattagatatgaaacgcgatgaaatgctggaggcgttcatgcagcttgccggggaacacgcttttccgctgctcagagccgtccagaacggtctttaccgaaaaacatcataatctacagaagttttacaatggctttatacatctttgatataaaagcgttattctgatcatagaataacggaaaacaaaggaggccgtcatgagtcgtttgcttcaaaatgcattggataaagagagaaaccattattccaaaaagcttctgcagatcggagtctatacgaaagaaatacttaattccatgacaattacggagctgagaaaggaatacgcgtatttttttcggaacattccctataaagaacggaacccttatacaaattaaatgatgtataagggtatttttttatataaaaaagaaggaattctgaaaaacggcacgaatagaatataaaacaaagaacgactcttatgaattgtaagggtttacattatttttttataaaaatcttaaatacggggtagatatgatgagattatcatttaacgaagaagaagtgatgcgttcgatgaatttgtacaaagtttttgcaagggctttcaagagtgtgtctgaacacagcatccgcgatagtaaagaacacggttttaatccgactgaatttgccgttttggagctgctctatacgagaggaccgcaaaagcttcagcaaatcgggtcgcgtcttttgcttgtcagcgggaatgtcacctatgtcatcgacaagcttgaaagaaacgggtttttggtcagagaacaagacccgaaggacaaacggtctgtttacgcccatttaactgataaaggaaacgagtatttggataaaatttatccgattcattcattgagaattgcgagagcgttttcaggacttatgcctgaggaacaggaacagctgatagccttactgaaaaaagcaggaattcacagccagcatttgcttttccgttaaaagaaagcggatacagacactcttcttcatgaagagtgtttttttctgtttcggacagtagagcctgaagcggtttttgcataagctgatacagggctgcatcattatttaccaatcataatgtgtcatgcctcatgccaaaatatgagggtgctttgaatataaagaaggtgaacatgtgagaagctgtctgctgtctatatggtacttacttgatccgctttatttcttctttacccggctgacgctgattgataaacggcaatcgaatgtattccgcgtccgtttgactagatataaaggaaaagatgtcatcctgagcgacggaaccaggattaaaaaaaacgacgtgttagttaagattcatcttcataatgtcaaactcctgaaagagctgcagcctattgaaagcgcggtcagaagggggattatgctatatcagaaggtatatcaatccatgcctcatttagcggattatattaaccagcataaacggaaagacgagattaagggagtcgtcggcattacaatgcttcataaaggagcggcgagactcggttttgatgtgataaaaccgtccagcggctgctacaggctgtttaagaaagcggcccatcttccgattttatactttactgcaaaacagctcaccctcaaaaacattccttactcctgctatttatttatttccaaagaaaaattgatgtgcacgtatcagactgaaaagagctgaccaaaagcgtcagctctttctcttgatttgctcaagcacgattgaaagcgggccgtcctgcggattccggtaaaaatcataaaacggatctccctctgtcctgacgcggttcactactgtatcgatcgtataatcatcaggtgttaaagaggagttgacttcgctccaataaaggggagccgcaaccgttcccaattcgttgccccgggtcgaatagggggcgataatggttttcccttcggcatgctgcaaataatctaggtagagcctgccgtttcggtttttgataaaccgctctgtcgtaaaaagatccgggcgcgtcctgacgcaataatcggcgatgagcattgtgaacgcacgggtttcttcataggtgaatgcttccggtgaaagcgggatgtaaagctgaatgcctttatttccggagagcttcgggaatgacgtcatgctgaatgagtcaaacagctgtttcagcacatgcgcagcctccactgccataggaaaatcattccttgacggaggatcaagatcaatgacgatttctgcgggcctttcagaatgcactgtctgaaacggaacgtgaaattcaagcgccagctgattagccagccatagaagtgacggtacgctgctgcatacgatgtgctcgtggctcccgtcaaacacgcttgtgacaaagtccggcgtgtagtccggtttgtttttttgaaagaaagattcgccaggcgcgccgtgcggataacggatcaccgtgacggcccgatctttaagaaagggcatcagaaaatcgctcattttcaccatataactaaggaaatctgctttcgttttttcacgttttttaaaaacgatcttatccaggcttgtgaactgcagcttcggcggcagcgttttagagcggaggataagctgctgatacgtgcattccgtccaatccatttcaaactgaaaggacacaaaagatacttcacgcagcgtgtcctgcaatatggttaaatactgcacggtcatgcagatagaaggctcaagtgtatactcgccgcttttttgtttttttccgtgggtctccataatggttctgacggcgtttttttcttccgcctgcatgccgtgggaaacggaagcgatcgggacgacgatgccgtctttcaaaacagaggccgtcacatacccgttcttcggattgaatccggttaatagcacgtgagccgttttcatatgtttatacttctgccagtcgggagagcgtttattttccgcccatccgctggaagtccttttggctacgataccttctccgtcatggcggacgaccttgtcccaaagcgcgtcaaagtcagtgtgctccggaatgtattgaatcgcttcttccgctaagtgatgagggcaggcgggaagatttgcttctttaagcagattggaaagggcgcgcttccgtttcacatacggtaatgagacggtgcccgcgccttccagaacgaggagatcaaatgccagaaagcggcacggccgtctatcagcggtgcttttaattgcttcggttcgttttaaacgtccgcggatttgaagatgctcaaagtccgctctgtacggattgattaaatagacaagctctccgtcaagcgtaatggggaacctgtctttcatgtgctgaaaacaccgggccgcaaaagccgtgatttccggaaattgattcgtcagcgtctgtccgtttctgctggttaatgtaacaccgttttcgtctatgcggagaagacagcggaatccgtcatattttacctcatagcgccactcactgccttcaggcggtacagaggtcaaaatcggctgcatcgtcagcaccatgattaagacgttccggctttttgtctggtcgtcttctgctttttgcctccgccgccagctgacgctgtgtcttttgtccgtgccggtgcagcctgttcgcgattcggccgcttcgtccggtcaatgcttgcctgaagcgcgctgacaagatcaatgacatcttctcgcgggccggcaggagcaggtgtcacgcccgcttcttcatgttcgagcttatcgttaattttggcgagaagggctttccggtatgtgtcttcgtattgttccgggtcaaactcggttgtcagctcattaattaatgtgatcgccgtctgcagctctttttcattaacggctgtctgctcaggaacgcccggcacatgtccggcatttctgacctcatccggataatgaatggattccatcacgatgcagttgtcatacacgcgaagaatcgcaagctgctgtttagagcggatcgtaatggaggcaatcccgattttacccgtcgtcctcagcgcttcccgcagaagtgtataggcttttgtgccgttgtctcccggcccgacataatatgaccggttaaaataaatcggatcgatttcctgcagctggacaaagtcaacaatctcaaccgctttttcttcatgttcctgttttacgtctttcaagtcttcgtctgtcataatgacgtatttcccttttacatactcatagcctttcacgatttcatcaggctccagactcttttcacatccggtgcagattttttcgtatttaatcggcgcatggtcttctttatgaagactgcggaattttatatctttatcttcagtggccgcaaagagcttgaccgggatattgacgaggccgaaactgatcgaacccttccacatcgtgtgcatgaataaaaactcctttttgtctttattgtggataaacgggtccgttccatgtgtagcaacttatgggtgatgcggcgttcatggagcggctattctatttcctcatgcggtaatagccggctgaaaaggaaatcgcatgtgaatcggtaagttctttaaatcgctgaagtccccgaaaatcatcaatggttgatcaaaaaaattatacagaatcattccccgggaaatgcccacgcatttccatgtagtgaccgagagaatttcccgctcccataaaaacagattcggcgatggcaaagatcccggcaaaacgcactgcccatatgaactgaattccggtcagcgccgcttaccgcaaatggtaactttccggagatcttaagtgatgtaaccgccgccagacgagcattcaggagacaggcgggacgttgtattgcgcatgtcattccctcccgctataccgatctgaaacgactatatttataacgggcatgtctaaaagatatttcagcctcaaggttttgtgttaaaatcattcttaagtttcagaatatagacgtaagccgggagtgatagatcatcgaagatttcatcatatcaataattgaagcgtttaaaagcttatcttacgccggaatttttttggcgctcagtatagaattcatcccggcggaaattgttcttccgcttgcgggctattgggtctcaaaaggggatatgacgcttgccggagccgtgtttgccggttcgctcggcggtgtttcaggtccgcttgtcttatatgggatcggcaggctgggcggtcggccgtttttgctgaaatatggaaagtacatatggataaaacccgaatttctgcagaaatcagatgatttctttcagaagcacggaggtttggtagcgttcagcggccgttttataccgggggtcaggacgctgatttctttgccgtgcggcattgcgaagatgaatatctgggtgttctctctctatacatatgcagcgatgctgccgattacatttgcttacgtatacctcggtatgaaactcggggaaaattggaaaagcgtcggttccattctcgatcaatatatgctgccgctcggtatattcattgtgttgcttctcgttctttggatgtttttgaagagaagaaaacagcgggtcaaaacagaaaaaatttctcaatttgttaaaaaagttaagcgttgacaaatgatgaaacaggctttatcatgagcgtataaacaaatatttcttgaaatcccaaaggggagtagcgtccggatattccggaaacaaagtcgtcaattcatggatcatatccatcgactttgttggcatgccaatcattcatgtctagcaagacctttgccttatatcggcaaaggtcttttttgcgtaaaaaaaccgccggtataagctcggatgatagaaaaaagaaacggagggaatggattggactttgcattattattggagtatggatgggttcttctcgttttaatcgggctggaagggattttggcggcggataacgcgctggtgatggctgtgatggtgaagcatcttcctgaaaaacaaaggaagaaggctttattttacggattggcgggcgcatttattttgcgtttcgggtcgctgttcgccatttcatttctggtgaatgtttggcaggtccaggccgtcggcgctttatacctgttttacattgcggtcagccatttgctgaagcggtatgtattcaaagataacgccgggcagaaaacgcagaaagaaagcgggttttggcagactgtcttgaaagtggagctcgcggacatcgcttttgccgttgactccattttagcggcggtcgcacttgccgtaacgcttccgggaacacggcttcctgccatcggcggcttggacggcggtcagtttctcgttattttagccggcggcgtaatcggtttaatcattatgcgttttgcggcatcaatgttcgtatccttactgaaaaccaggccgggccttgaaacggcggcatttgtgattgtcggatgggtaggcgtgaagctcgctctttatacgttggcccatgaggaactcggtataattccggcagatgtcatccattcggcggcctggaaaatcattttctgggcggttctggctgccattgcggtttgcggatggtttatgtcaggagcaaaacaaacagagtccggcgcggcatcggaaaaaagagaacacgcgtaaaatgatcaaaaagggagtctggctttttagaaagcaggttcccttttttgtttgaagcgcttacatttaagacatatgataacaattttataacagcattgttacaaaaaacacagagaaaacccccttaattctgcatgggggcacgaaatcatgtatagtacgtcttattggcttgtcataattgagacaaatgaaatcgatttctctttttcttcctttgcgaatccctactaaattagctatgattatgagtagttatagggaggaactgaggtgaaaccagtgcttagccttttgtttaaattgggaaaaaagaagcaaacgcttgaaacatctgttgaaaaaatacaaaaaggcgacaaagatctgcagaacgatttaatacagcaatataagccttttatcgcgaagacggtttcatccgtttgtaaacgatatatagatgaaaaagacgacgaattcagcatcgggctgatcgcgtttaacgaagctattgaaaagtattcggctgaaaaaggtaattcgctgcttgcatttgcagagctgattataaaaagaaaagtgatagactatatcagaaaagaagcaagaaccgctcagcatatcaatatggatgtgcaggagggcgacgaccaggaatcttcgcagagccttatcgaagcggagctttccattgatgaataccgcaaacagatagaacaggaacagcgccgggaagaaattcttttttttcagaagcagctgaaagaatacggcctgtcttttaaagagctgctggaacaatcgccgaagcatactgatgcgaggcagaatgcgattaaggtagcctacacgcttgttgaaaatgaagagctggcgtccattttgcaccagaaaaaacagcttcctgtcaaacagctggagcagcttgtgtcggtcagcagaaaaacgattgaacggaaccgaaaatatatcatcgccatgagtattattattaccggtgattatatttatttaaaagattatcttaaaggggtgttgcactcatgagaagagggatcatagtagagaaaaataaaaaattcgtcacgttgctaacccctgacggacaatttttaaaaacaaaaaatgatcaccgcacttgtgaaatcggagaggaaattacgttcgaaggcgaaacgcgtatgggaagaagggccagcttttttgattttctgaaactgcgcccttttaaattgggagtgtttacgatgactgctattattttgtttattttaattttgctcccggttttttctgataacaaagcttacgcgtatatgacgcttgacattaatcccagcattgaaatggctttaaacagcaaatatgaagtcattgaactgacaccgctgaaccatgacgccaaacaggtcatcagtgacatcggagattggaaaagcagcgattttaaggaagtcatcaataatattattaccgattgcagcaagcatggatatgtaaaggaatcaaaagagattttaatttccacggtttatgaaaatacagatgacaatacatataaaaaaggcgttaaaaaacagctggctgacatgactgaaaaatataagggcacctaccaggtccaatctcttgaatctgatatggaaacaagagaaaaagcaaaacaggaagggatgtcaacaggcagctacataagaagaaacgaaaagaaaacagaagaaaaacagtctgaaaagcaaaccgacggcaatgaaacagatcaaaaagataccgaaacagacgctgatcaaagcaaacagccggacacagaaaagccggcggctgatgaaaagacagctcctgatgaagaaaaggcagcagagaagccggaaaacaatgaaacaacgcccggcacggaagaagcgaagccggacagtcaggacggcagtcagcaaaccgacaaaaatgcagcttccggatcagaagaaaacacacagaaggaacaagatggggaaacagagcagcccccaacacaaaatcctcaggaaaacggaaatgacaaagagcctaagcaaaagtattacaatcattactggaatcagcggaatcatgatcgcaatgaacattgggactcctatcggcatcatgaagattcgtcagaccgcaggaatccgaacggctaccggcacggaaaggagaatgccgataaatatcaaaattcgccgagaagtcccggcgaataagctgcattattgatttttcccgtttaattgtgattgagcctgctgtacaagacgttttgtcatttccccgcctacagagccgtttgcgcgtgctgctgtatcagagctaaggttcacgccgaattcttgagccacttcgtatttaaattggtcaagtgcctgctcagcccctggaactaagagtttatttctgctcgccatctttttcatctccttttctctggcaagatgtgtttacgcattttagtttcaaacggaacggtattgattatgctggcaattgttgtacagcaaaaaaccccggcgcagacaccggggcgaagaagcgttatgaattataataaatggctggtcattttgtaggctgaggcttgaatatggaaagtcaaaacggagagcaccgtgacggcgatgatggatctgatatcgttccattgtccgcttccgagttctttaaagcagcctttgagcttgtccgtctgctcttcgacgagctcctgcaggctcgtttccttcatcggcgggtttgctttatgatgaagataatcaatcacttgggcgcagctttcatagtagctgatcgggctgatgacgtcgtctgatctgtctgtgatcgtgttaaaagcgatttttaatatgccgcgtatatgttcgaagtcataaattgattttaaatcacgtacaatgagaaggatgacagcttgttcaattgtatattttttgccgagtaaggggtggccgattaaatctttaatatcgcgcttcacccagttttggacggcggttgattttaaagacgtcagctcgcacagatttcccagctcgacaatctcgttagttgaaagcccgtattcctttttctctttttttcgttcgaatctcgtcagaaattcagggatatgcagacggctttccgcttcatccaatgtcatttccgctgattgcaataagatttggagaggagttgcgtctccttggccttttaacgcgtaaagaagccggaccatatcagttcgggtcagtttaaacgtgttcatggttcacctctgattgattacgtgttcactttctgatatcactgagaattacatttacatcatacgtcgaaattgttgcattttcaaacagatcatttataatttaattaaataagttcttttgatcttaaaaaagacggaggtaattatggcgaaaagaatatttctgtttattttaacgaaccttttggtcattacgacaatcggaattgtgcttacgattattacaagcgttaccggtgtcggctcgtatatacaaaatggccgcattgatctgatggcattgctcgtgttcagtcttgtcgtcggttttgtcggttcttttatttctctcggaatgtccagatggatggccaaaacgatgatgggcgtccgggtgttaaatccgaagaaacagtcactcagctatgaagaacagcaattggttgaccgtgtgcacagattgtcccgtgccgcagggatgacgaaaatgcctgaagtcggcatttatcagtccccggaggtcaatgcttttgcgaccggaccttctaagcgccgttcgcttgtcgcggtttcttcaggtttattgcagcagatggatgatgctgcggtggaaggggttcttgcccatgaagtcgcacacatcacaaacggtgatatggtcacgatgacgctgctgcagggaatcgtcaatacgttcgtcgtattcctttcccgaatcgcggcatgggttgcaagccgctttgtcaaagaagacctcgcaccggtcgtgcattttatcgcgatgatcgtgtttcagattatcttttccattctcggcagtcttgtcgtcttcgcctactcgcgccacagagagtttcacgctgaccgcggcggtgcagaccttgccggcaaggataaaatgattcacgccctgcgtacgctgaagtcttatacaggacatgtgaatgaagaagaccagacggcggtgcagacgttaaaaattaacggcaaaaagcattcgtcactgttctccacacaccctgatctcgatgagcgcatccgcaggctggaagcaaaataataaacaaaacctctgacaatcgtttcagaggttttttgtttaaagatcggcaaattacataaggtaatgaaaaatctttcaaaaaaggcctttaaaaattctcccaatatcattagaataattacgtactacatttgagaggcagaaggaactatcttatgaaattaaaactgaagaaattcatacagatcttgtcgcctgcacagctgattgcattatactattttcttgctgtgacggtggcatttattttgctaagtctgccggccgcccacaaacaaggggccagctggtcgtttatagacgcgctgtttacggctgtcagctcagtcagtgtcaccggtttaacggtcgtcaacacggctgatacattcagcacggccgggattgtcattttggctttcgtgcttcaattcggcggaatcggcattatgacgctcggaacattcgtctggctcattatgggcaaacggatcggtctgcgggaacggaagctcattatggtggatcagaatcaatcgcagttttccggtatcgtcaacctgatgaagcaagtgctgtttttgattttattaatcgagtttttaggcggcatcatcttaggaacatattttttaacatactatgattcgtttgaacaggcgtacttgcacggattctttgcgagcgtcagcgccacgacaaacggcggctttgatattacgggaaattcactcgtcccgttcagacatgactatttcgtgcagtttattacgatgcttctgattattttcggtgcgatcggttttccggtgctcgtagaagtaaaagactttttgttttcaaaacagcgcagatactcattcacgctgtttacgaaaattacgaccgttacgttcggaatgctcgttttgttcggagccgtgggcatttacgcgcttgaagcaagccatgttatgaaggggaaaagctggcatgatgttttatttttatgtctctttcaatcaactgctacgcgaagcggcgggcttgcgacaattgatatcagccagctgtcggcgccgacattatttttcatctgcgccctcatgtttatcggcgcatcaccgagctcggtcggcggcggaatccgtacgacgacgtttgcgcttaaccttcttgctctgtttcattttgccagagggaataaagcggtcaaggtctttaaacgcgagcttcatcaggctgatgtcatgaagtcgctggtcgttacgatgatggcgattctgctcgtgttcgggtcgacgctgattctttccgtgacggagacaaatcagacgctcctcggactgctttttgaagtgtgttccgctttcggaacgaccggcctgtcgctcgggattactccgcatttaagcgatatcggaaaatgtgtgatcatgattgtgatgtttatcggccggatcggcattttgactttcctttatttgatcggccgaaaagaaatcgaagcaaattatcattatccgaaggaaaggatgattatcggctgacaccgcttttcagaaagcggtgtttttttattgccgtaaaatggatgagtggaaacagtttctttggagattctacttgtaaagaggtgacgtcattgtttgccgtattttggaagtcggtagttatgatcgcggtcggtacctttttattgcggattgccggacggaaatccatcagccagctgtcggtgacccagacagtcatcatgatttcgatcggctcgattattattcagccgtttattgaacataatttatgggaaaccattttcgcggcggcgatttttattgcggtactgattctgatggaatatttagaaatcaaatcaagcttttttgagtttctattttcaggaaaaaccgtcgccgttgtcagaaacggaaaaatcatcccggaaaacttaaaaaaaatgcgttttaccgaagaccagctgtcaatgaggatcaggcaggaaggcctcggagacattcaagattttaaatatgtgctgcttgagccgaacggacagatcggctatgaactcattgatgaggccaaaaacgtgacagtgcgcgacttaaaaaaaatgcttaatgaattcaaaacagatttgctgacagaaggaggaaatcaaatgaaacgcaaagcagcaaagaatgaagctttgaccaacaacaatacaccgactgagagcatggacaaagatgcatacaaaacacaatatgacggtgatcccggactgagaggcgcaaaccgcaaatcaaaacacggcaaacaaggaggcgagtaatatgacgaaaaaaaaccgccacagcaaagacatgcaaaaccataaaaagccgatggaccctaaattgcttgaagaagagttttcaagcgagctcggtgattataacgccggaaaatggattgaaacgcttgaacagacgaagccgaagaaaaaagaagacggcaaaaaataaaaaatacctcttaagcggcaacgcttaagaggtattttgcattatttcgaataagcaccgtttcttgttcctttcaccgcttgaagcaagccggttatccgcagctcaataaacggctgtgcggccgttttcaccgcattgctggagagaatggacgtaagagcggccgttaacattaagagcatgactaaattctgataatcagacaagtgatcttcaagcccgatctgccgcagcgtttttataatgaatccatgcagcagatacacgtaaaacgttctcgtaccccatttcgtaaagaaataacgcttttgcggaacgagcgccaaaaagctgaaagtggcggcaaaggccaaaacataccagccgatgcgcgacagaccgctcaacagcgacactgtgccgaatgtagaataaggctccgatccgaacagccacgagtaatcaaaatcaatgcaccagcataagaggaaaacaatccccagtacgcccgcggcaatctgcctgcctcttttagcccgaagcaaatcaaagtgccgtttctttaaataaaacccgacgagaaacatcggaagaaagacaaacgtccgtgaaagactcagcgtgctgctgatgaaatcgagatacccgatcatgacggcaagcccgcagctcgccccaagcgcccacattttcggcagcttcgtaaagggataaagcagcagattccaaaagaataagctgactaaaaaccagagagaccactgcggatcaatcggattgacgcttgccatgctttcatcctgaatcaaatagtaaaaaaccgagtaaatgccctgaaaaatcaggtacggaataatcagcttcacagccagcttcttcacataacctttccgcttaaagttttttgcgaaatagccggaaaccaggataaaggccggcatatgaaaagtataaatgaatttgtagagatggagcataaactcatttccgttaataaatgaccggaggatatggccgaacaccaccagaaaaatcaagataaacttggcgttgtcaaagtaactgtctcgcgattttgtcatagcatcaccttctcttcaaaaatcatccactgcatgattatttcctgttggtgttcattttaaaataaaaaacaaaaaattgaaggaggacaaaagggattgttaggatgatgtaacggggaggtaaggatcgtagaaaaagactttaacttgtcatatcattgaaattttctgaaatgtatagggcgaatgaaggaagatgaggtattttgtagaaatattgaaggataggtttttgaagaaggagtgtactgaatggctgaaactctggatttgcaaacaaacgagtcgctgaaagagcagctgaagcggatgaaagaggaaaatgaccgcctgaagagtgatttgaaccggtatcatgtgattatgaataacacgcttgatgccatttttatatgccgtaaggaaatgaaaatcgtccaggcgaacgaggctgcggcccggatgatgcagattgaggcagagagccttattaaccgctccgtcctggactttttatattccgtgcctcaggaagaactgaataaggccgtgaaaaagtttttaaaaaaaggccatctgtggaaagaggtgccgattaagcttgacagcggcgcgacgaaatacattgaattcctcgccagagacggaattggggaggattatttttttgtggtgatgagggacatctcctctaaaaaaatattagagcgcgaattctccatgaacgagcagctgtttaaagatttgtttgacagggctgtcgacggcatcgtgctgtttgataaggacggcgggtttattgatgcgaacctctctttttgcaaaagctttgagatcggccagaatgaattgtcccatctgtcgctccgccattttaccgacggcgaaaacaaaaagcatctgaaagaaatctgggaaaccctccgcagaaaaggaaatgccaaaggagaactgcccgtcaagcttcggtccggcgaagagaagctgtttgaatttacgattacgtccaacttaatcagcgggttctacatgtccattatgagagatataacagagaaacggttgatggaattgaaactctttaaaagcgaagagcgattccgcgaaatttttgaaaacgcgatggacgcgattgtcatttggtctgatgacggaaagattgccaaagcaaacgaatcggcgtgccgcattttcgaactgccgatggataagctgctggagacgaatttatgtacgtttatcgttgatccgcagaaaaaatacaagcagattaagaagaaatatgaaaaatacggggaaatccgtgaagaaatgctgtttcagatggcgaacggccaatacaaagagcttgagtttacatcaaaacgaaccatacttgaaggtcagcatttaaccattttaagaaatgtcagcgatcgtaagcggatggaaaaagaattgcgggaaagcgagctgaaattcagaaaagtattcaacggctcaatggacggcaaggtcttatttgacaaccaattccgcattattgacgcgaatcctctcgcaagccgtatactcggcatgccggatgaggagctgagagcgtacaccgttccggatattctttctttatttgatattgaaaacgcgggtgttcccgccagaaagattgatttagaaggaatggataatgaaatccccttcctgttaagcagcagtgacagccgcaaactggaattctccttcaaaagaaatatcattcaaaatatgaatctggccatctttaaagatgtcacagaggccaaagaacttgaagagaggctgcggaaatccgacactcttcatgttgtaggggagctggcggcgggcatcgcccacgaaatcagaaacccgatgacagcgctgaaagggttcattcagcttcttcaaggaagcattgaaggcgaatattccctgtactttaacgtcattacctcagaattaaaacgcatcgagtctatcatcactgaatttttaattttagcgaaacctcaggcgatattatatgaagaaaaagacgtgacgcagattctgaaagacacggctgatcttttgaatgcccaggccaatcttgtcaatgtgcagattcatctgaacctgaccggaaacatcccgccgatttactgtgaaccgaatcaattaaaacaggtgtttatcaatattttaaaaaacgccattgaagtcatgccgggcggcggcaatatctacgtgaccatccagccttctgatcaagaccacattttgatttcttttcaagatgaaggaacaggcatttccgaagacaaattaaaacgtctgggcgagccattttacacgacaaaagacaggggaacgggcctcggtctgatggtcagctataaaatcatcgaagaacatcagggacgcattcatgtggaaagtgaagaagggaagggcacggtttttcatttgacgcttccgatccggcagaataccgaagaaagaaggagcggggaatgatctgttttacaagtgtaaaagcgccgtttggaaccgttatcgtaacagaggaagagggctttattaccggcctgtttctcaccggggaagattttgaggaatggcggaaagacgcgcccggcgtaaagccgtgcgaaaccgctttgctgtcggaggcgaaacagcagctggcatcctatttttcaggagaaagaaagcaattctctctgcctttgagacaaaaaggcacaccctttcaggaaagggtatggaacgcgctgacgatgattccttacggggaatcccgaagctacggcgatatggccgaagcgatcggaaaaccgaaagcggtgcgcgccatcggacaagccaataaacgaaaccggctgccgatttttgtcccgtgccatcgggtaatcggcaaaaacagcgccttaacgggatacgcgggcacgaagacggatgtaaaagcggtgctgctgaacatcgaacaaatatcctataaagaaaaataaaacatatggcacgttccgtttttttgcgtccgacatatcattttattaagtgaaaaaagttggtctggtgaaaaaggaggacgaagcctgatgaaaatgagccgtccgcaaaagatagccggttatgcagagctgttttttaaaatgcatctcattacagccgcccaaaaagatgaagtgattacattgtgcagacaaaaaaaccgctgacattgcccgaggcaacatcatcagcggtttttcagctcagctgacagtctgcgaataattgttcaatttcttccgtgtaagaaccggtcacaattcctttctcggtgataatgcctgaaatcaggctgcccggtgtgatgtcaaaggccggattgaagaccggcacatcttcgggagcggtgcgtatgcctgagatctgtctgacttcatccggatctctttcttcaatcggaatctgatcgccgttttcaatctgcaagtcaaaggtcgaaagcggtgcggccacaaaaaacggaatctgaaaggcgtttgccaaaatagcgaggccgtaagttccgattttgttggccgtatctccgtttttagcaattctgtcagcgccgacaatgactgctgatatatgtttttccttcattgtatgggcggccatgctgtccgtaatgagtgtgacatcaattccgccctgcatcagctcccacgccgtcagccgggatccctggagaacgggtcttgtttcacatgcgtagatatgaaggccgaggtctttttgtttcgctaagtaaaagggagcaagcgccgtaccgtaccggcttgtagcaatcgagcccgcattgcagatggtcatgatctggtcgccttttttaaaaaggtgcagcgcattttggccgatcattcggcaggtttcttcatcctcaatctgaatttgaatagcttcatgaacgagcgttgttttcgcttcattgattgagattgcatccctgatggaatccgtcagtctgtcaagcgcccacgcgaggttgacggcagtgggcctcgaactgtttaaatacgctttgacatccgcgaactgacgtcggaaatctgaaaggtcgcgggcttcaaatgacttggcggagagcgcgagtccgaatgccgcggttataccgatggccggggcgccccttactttcagcgtgacaatcgcgtcgaatacatcttcctttgtttcaagttccacatactcagtgacgtcgggaagtttttgctgatttaaaatgcggatgtaggtttctttccattccacggaacgggggatggcaaattcattggtcatgctgcatcattcctttacacggagcttaaattggtccagaacttcggtgatatgcttcagttcttttctgttttcgatataataggcgccgatctcaagcgccagcttcttccgttcgattcgtttgtcaaacggagtgatttcatctaagtcagccacatgggcgagtccgatcgtgcgccggatcaattcgcatcccgcaaaaccgaccgcttcctcaaacgcgtttttcagtgtgtcttccagcaggtgtctgtgggaaggcaggcagtctttctcccatgcttcactgaatgttttcacaaatgtatcccatacggcggcagtatggtcatataacggctgtctgtcgtcaccgtcgcggctgagggcgtttaacagcagattggcgataaattggccgatgtcaaacccgatcggtccgaagaaagcaaactcgggatcaatcacctttgtttcatgttcatcggcgaagatgcttcccgtgtgcagatcgccgtgaaccaatgtttccgcggaattcagaaagatggctttcaattcgtcagcgccttctttcagccgggaattgttccaaactttttctgcgtacgggcgcagctcctcttcaaaatcgttggtctcatggtcgagaaacggttctgtaaacacaagcctttctgtaatattgcaaagctcaggatttgtaaactgctttgcgagctgctgctttactttcgcatcaagcgcataatcggatgagtaaaaaagcgttttccctaaaaattcaccgatatgaaccgataagttcggataatgctgcccttccagcagcccttttcttgaaatctgcaaatgtgagaggtcttccattaccgtgacggccatttcagtatcggaatagtaaacggccggaacgaggtgcggcacgtgttcgccctggcggatgagggcgctgctttcgattctcgcccgatcaattgtaagcggccagctttcaccgacgactttcgcgtaaggaatcgcctgtttgataatcagtcctttttggttttctttatcgtaaacatgaaagacgtaatttaaattgccgtcgccgatttcacggcatgtcagagtgcttttgctttggaataagccgagcttgacggctaacgcggcggcggagctttctgttaattgttcataaagacttgttttagttgctgacatggatttaccctccaattatgtagtggcagtaagagatcgtgacggagaatacgcccgaaaaaaagcctccttctctgaaagagaaggaggctgaaacagtgcagtccgcctcttatctctcagataacatctgatggaattagcaccgtgccttatgagacaatcgtctcggcgcaaaatgtacgcgccccatttcacaatggaattacggtcggttgctgttggggtcaaaaggccaattccctcgcccaactctcgataagagaaaatatattgatttgtatcacaattcggattaatcagttgatgaaaatattagcaggtgccggatattcttgtcaacatttttttgaaaattaatataaatcacgccgcaagtcttggaaaaccggaatggttccgcggacggccgcgctttctgacacatcgatttccgcccggactgcgccttccgtccggtctccttcggctaaaatccggccccacgggtcaataatcaggctgtggccggcaaattcattatcgggattggaccccgtgcagttagaggctgcgacaaaacattggttttcaattgctctggcgataagcaggcttcgccaatgatcaaggcggggcagaggccattccgcagagataaacaggacattcgcgccctgggacgtatgctttctgatccattcggggaaacggatatcatagcagatcagcccggcgcacttgacaccgtcgagctcaaaggaaccgtcgctgtttcccgctgacaagtaaaggtgttcatccatcagctgaaacagatgggctttctgataccgcttcacgatctgtccgctgttatcggcgatgtacatggtgttatagacattttcgccttctttgaccgcaaaagatccggcaacgaggtgtacgttgtatgtttttgccgtttctttaagccattgttccgaaactttgccgttttcatccgccagctggtctagccgtgtgagatcatagccggtcgtccacaactcaggaagcacgattacatccgcatggcggctttcttgctcaatcaaagattccgcttttttaaaattttctgaaggatttccgtatgaaatatcaaattgcaaacaggaaacggtccatttcattttttaacacctcaagtttctctttactttttttatttaaccatatatgatgatggactatcatttcaagacatttttagaaggtgaaaaatatgaactttgaaatctcagatgtactcaaacagctgccggaacaatttttcgcatcattggtgcaaaaagtaaatcaaaagctgaaagaaggcagagacgtcatcaatttagggcagggaaaccctgatcagccgacgcctcagcatatcgttgaagaaatgaagcgcgccgtcgaaaggccggaaaatcataaatactcatcattccggggcgcttacagcttcaaaaaagcagccgctgcattttatgaaagggagtacggggtcacgcttgatccggacacggaagtcgccgtgctgttcggaggcaaggcgggacttgttgagcttccgcaatgtcttttaaacccgggagataccattctggtgcctgatcccggatatcctgattactggtcgggcgtcgcccttgcgaaagcgaaaatggaaatgatgccgctgacggaagaaagagggtttctccctgattacagcgtaattcctgaaaaggtgcggagcgaggcgaagctgctgtatctcaattatccgaataatccgaccggcgctgtggcgacagaggcgttttttgaggagacggtcggttttgcggaacaaaacggtatttgtgtcgttcacgatttcgcgtacggagccgtcggctttgacgggcataaaccgctgagctttttgcagacggaaggcgcaaaggagacgggaatcgaagtctataccttgtccaaaacgtataatatggcgggctggcgggtcggatttgccgtcggaaacgcttctgtcatcgaagcgatcaatctttatcaggatcatatgtttgtcagcctgtttcccgcggcgcagcaggcggcggcagccgctcttttagaggatcaggcatgcgtcgcagcgcaaaatgacagatatgaatcgaggcgcaatgcatggattgaagcctgccgcggtatcggctgggatgtgacggctccggctggctccttttttgcatggctccctgtgcccgacggttatacgtcacagtcgttttcagatctgctgctcgagaaagcggatgtcgccgtcgctgccggaaacgggttcggaaaatggggggaaggctatataagagtcggtcttctgacaagtgaagaaagacttaaagaagctgcggaacggatcgggaaactgaatcttttcacccgaaaaagcattgacatatctggataacaatgcgataattcaaaatactttataaaatcattattcttatcaagagcaggcagagggacgagcccgatgaagcccggcaaccgactgataaagcacggtgctaattcttgcagcaggagctgagagataagattcggacataacacgaagcctctttctgctcatacggaagaggtttttttatgttttgtgaaagaaagagaggcgttcacgcatgagcgaagtattggcaacatatcttctgacagacacaacggacagtgaaaagcgggcggaacagattgcggcggggctgacggtaggctcctggactgacctgcccctggtgaagcaggaacagctcagaaaacataaaggccgggtcgtaaaagttgaggagaaagaaggaacctcagaaaacgaaacacaatccgtcatcactatcgcctatcccgaggcgaacttttcaagagatattccggccgtcctgacgacggtattcggaaagctgtcattggacggaaaaataaaattgactgatcttgaattttccgaagggtttaaacgctcccttcccgggccgaaattcggtatatacggcatccgcaaactgctgggcgaatttgaaagaccgcttctgatgagcatatttaaaggcgtgatcggacggaatctcgccgacattaaagaacagctcagacagcaggcgctcggaggcgtggatctgattaaagatgacgaaattttctttgaaaatgaactggctccgtttgaaacccgcattatcgaaggaaaacaagtcctgaaggaaacccgggaggagacggggcataaaacgctgtatgccgtaaaccttacgggaaggaccgctgaactgcgggataaagcgaggcgcgcggcagaactcggggcggacgcgcttttattgaatgtgttcgcttacggtttagatgtgatgcagagccttgcagaagacagggaaatcccgcttccgatcatggcgcatccggcagtcagcggcgcgttcacttcatctcccgtttacggcttgtcgcatgcgcttttgctcggcaagctgaaccgctattgcggcgctgatttcagtttatttccgtcaccttacggatccgttgctcttccgaaggagtccgcgcttgcaatccatgatgaatgtgtaaaagacgatgtctttcatccgtcgtttgccgtcccgtcggcaggcattcatcccggtatggtgccattgttgatgcgcgatttcggcatcgatcacatcatcaatgccggcggaggcattcacggccatccgaaaggagccgagggcggcggaagagcgttccgcgccatcattgatgcggtgcttgaagcgcagccgattgaagaaaaagccgcgtcgtgcaaagatcttcagctcgcattagacaaatggggaagggtggaagccgtatgacccgcacaccgctgattatttgtgatttcgacggaacggtcaccatgaacgacaacattgtcagcatgatgaaagaattcgcgccccctgagtggattgaattaaaagacggtgttctgtctaaaagcctatcaatccaagaaggagtcggccggatgttcggactgctgccgagcagcttaaaagaagaactgacagactttattctgaaggatgcgaaaatacgggacggctttttggattttgtctcgtttgtccggtcaaacggcctcccgttttatatcgtaagcggaggaatggacttttttgtgcatccgcttttggaagggatcgtagaaaaggagcggattttctgcaatcatgcatcctttgacaatgaatatattcatatagactggccgcacgcctgtgacggaggctgcaccaatcaatgcggctgctgcaaaccgtcagtcatccggaagctgtccgatcagcagaaatttctcattatgatcggtgattcggtcacggatgttgaggctgcaaagttatccgatatgtgttttgcgagagattatcttttgactgaatgcaaagaactcggcctccggcatctgccttttcaagattttcatgaggtgaaaacaggcattgaaaacatcggggaggtgcaggcgtggctgtaaaagaagaacgctggcgcgaacttgccgaggtaaagcgcgagctggccgaaagagactggttcccggcaacgagcgggaatctttccatcaaagtatccgacgcgccgctgactttcctcgttacggcgagcggaaaagacaaacgaaaagaaacagacgaagattttctcttaatcgatgagaacgggaagcccgctgagaccggccattctttaaaaccttcagcggaaacgcttctccatacttacttataccaaaagacagaagccggctgctgtctgcatgtccataccgttaataataatgtcatctcagagctttacggggatgaaaaacaaatcacgtttcaggggcaggagatgattaaggcgctcggattatgggaggaaaacgcgtccgtgaccgttccgatcattgacaacccggcgcacatcccggcattggccgaaaacttcgcgcaccatgcggacgccggctcaggcgcggtgttaatccgtaatcacggcattacggcatgggggcggaccgcatttgaagcgaaaagggtgctggaagcctatgaatttttattcagctgccacctcaagcttctgtcactgcggccgcagcttgtaaaataaaaggaggaacggaaaatggcgaccatcagaatacatgacgaaaagaatacgctcattgaaaatcaggaagaagtagcgcgctttttagacgaacaagaggtgatctatgagcagtggaacattgaaaaacttccgtctgagctttcggagaaatacaatctgacagaagatgaaaaagaacggattctcgcggcgtttgacacggagattcaggacatttcagcccggcgcggatatcagtctcaggatgtcatttctttatcagataccacgccgaatcttgatgaattattaaaaaatttccaaagagaacatcaccacacggatgatgaagtccgctttatcgtcagcggacacggcatcttcgtcattcaaggcaaagacggcacatttttcgacgtccgtttaaatccgggcgatttgatttcagttccggagaacatccgccactactttacgcttcaggaagaccgccgggtcgtcgcaatccgaattttcgtgacgactgagggctgggtgccgatttacgaaaatgaaagtgtgcaaaactgatagacgcccgaacctctcatgcccccgccggtatgagaggttttttattgtaatataaagtcagctgtggctgttttttaaatcttgaatatgccgcattctgtttatatcattacctgaatgggtattattctcgtattcatgctaaagattccaatatgaaatgaaaaaataagttatttagtaaaaaaatgtttacaaataaagtataatctgtaataatgctcaataacccaatcaaacttgtttcctattcttttagcggtgaggggtgaagtgaatgggcagttattctgaacaagaaaaattgcttgtatctattgataaaaaaagaaaaatgatgatagatgcggctaacagacaagggtttaccggatatgacacgatcaggcacagccaggaactggactgtctgatgaacgcgtatcagcagctggtaaaccgtgatcgcacacatcaccaaggaatacagggccttgtgaagaaaataggcttgttctcccgcggtgacgtcatgcctgcatatgaagcaaacaaatgattgatgataaaacagataacgaagactgaatgcgcttcctgatcaagcgccgcatccgaaagatgaccgcgtacagtcagcagatttttccgctggcacggctcacgaagcgcctcgtactatctgccggctatgatgccgttcctctggtatatcctcttacacatattcttctttaaataaaaaacaccccgacccagggtgtttttttcatcgtgaagcggcaggaagggtaatggtgacctctgtgcccttatcgacttcgctttgaatgtcaatcgaaccgccgtacatcagcatgattcgtttacatacgacaaggccgaggccggtgcctttttcctttgacgttacaaacggaagaaaaatgtgttcaagcatatcttcagaaatgcccattccgttgtcggccaccttaatgactgctttatggtcgcgggcttctaaatagatggacagccggccgccttcctgcatggattccagcgcgttttttgcgacatttaaaatcacctgtttaatatggtctttcgtgcagttgaccttgagcggccgattgacgagaatctccacattcacttccacattatacagattcccttcagaataaataatcggcataatctcatcaagaatatcctgcagcgagttcacttccaaccgttcagcagtgggtttaccgagcactaaaaactcactgacaatctgattgatccgtttaatctcctgctcaataattgagaaatacagctgatcttcctccgatttgtattttttctgcaaaagctgaatgaagccgctgatccctgtaagcgggttgcggatttcatgggcggtgctggcggcaagcgttccgatcagctccaatttctgcgcttcattttgagcgcgctccagctgggtcttgcgcttaagcagataatattggacgaggatgaacagaatattcagcagcacggcaatactggacatcggcagcagtacgcttttggtcagctcgttcagctcaaccggtttcggataaacattgatattccaattaatatcatccagatagccgctgaccggtttcaccccttctgattgatcagcccgtccgctggcaaatatcactttattctgattggttgccttgacataaacgtcagggctcagcatattgatcatatttctcaaataatcgacttgaatggcggctactaaataatccgtgacttcccgttttgcgtctaacaccggcacgcagatcgtgaagatgcgctggcctgtaattctgctggagtagtcatttgtgataaccgtttttttcgtctttttcgccttcgtaaaatacggtcggtcggccaaattcacctttgatttcagatcagtcgtgcttgcgatgacatcacctttggaattcagcatatacagaccgctgaatctgggttcatcctcaaaagcctgatcgagaatatcaatgatcttttcttcattgacaggcttatcgacagcgatcgcaagtgttgtcatccgggcttttgtttcaccgattaaataattgagcttattgcggtgaaggttgagcatcatactggcttcctgtatgtgtttatcggctattttctgcttttctttttcataaatgaaaaagctgataataagtgccgggatgatcaccaatatgagataaagtttgatctttccccgggcacctttaaatgtattcactctgcatcgctccaacattacacttgaatagaggtattatatcatttttatacttctttaataagaaaaaataaccaaaatgatagaaaaacaaattattttattaaggccagacaaaaagaagagaaattttggaaacatttttgttgacatttttcattttgtttattaatgtttctctgtaacggtttcttttgtaaaaggatgattgaatgtatgacggataaaacagaaaactcattgaaattatttattgtactgtcacgtgcgtaccgatctattaacgaccatatgaataaacatattcataagcacggtctgaacccgacggaatttgcggtgcttgagctgctgtaccacaaaggcaaccagccgcttcagcagatcggcgacaaaattttattagcgagcggaagtattacatatgttgttgacaaattagagaaaaaagaacttctcatcagaaaagcctcgccgactgacagaagagtgactttcgcacaaatttccgaaaagggaatccgtcttttggacgatattttccctgatcatgctgaagaaattaaagaaatgatcagtgtgctgagtgatgaagagatagaaatgtgtacggaaatgctgaaaagagtggggttaaacgctaaacattttcatcagaaataaaaaaggaagccgtttgaaaggcttccttttttatattactgattttggtcagtcgcggcgtttctaggctgtatcaatacctcgacgcgcctgtttttgctgcgcccttcagcggttttgttcgacacggccggtttatactctccgaaacctttggcgctgaatacttttgcgtcaagtttcgggttttccgtgagaatagccatgaagttgacggcccgcatgacgcttaaatgccagttagattgatattgtgagtttttaatcggcacattgtccgtatgtccgctgatgataatattcctcggcggattcagcacaaggagattcgagatttccttggcaagcggaatatcttcctgacggatgtccgcccgtccggaatcaaaaaagatactgtctttaatggtaattaagagtccttctttagtcagctttgtttccagctgagtttcaagctttttgttttttataaattgattgacttgcttttgcacgccttcaagttcttcgcggtcggctgcttctctttctttctttttctgttctttatctttttccttgtctttttttaactgatcaacgccgtctttttcgttttcaggaggggtgacgcttgaatattcaagaacacccgtgcctccggtaaacacggcgttaaatgatttagacagcatttggaatttcgccgcatcgaccgagctcatggcgaacaatacaatgaacagagccaaaagaagggtgagcaaatccgcgtacgggatcagccaagactcatccacatgctcgtcatcatgcttcttcttcttttttctcgccattgtttgcctctccttcttgttcagcgacttttgcgcgttcattcgcaggaagatacatgagaagtttttgttcgatcactttcggggcctgtccttcaagcactgacagaacgccttcgatcatgatttcacgcagtttgacttcctgctttgatttgcgtttcagtttgttggcgaagggatgccatagtacatatcctgtgaaaatcccgagaagggtggcgacaaacgccgcactgatggcatgtccgagcgcctcggtattgttcatgttggaaagagcggcgataaggccgatgaccgcacccaaaacgccgagtgtcggcgcatatgtgccggcttgtgtaaagatggctgcgccggcctggtgtctgtcttccatcgcttcaacttcttcagtcataatatctctgataaattctgcgctttgtccgtcaaccgccatgctcaggccgttttttaaaaatgcgtcatccacgtcttcaatgcttgcttccaatgcgagcagaccttcacgtctggcgatttgcgcccattgagagaacataggaattagttgcgcaattgtcagctgtttgttttctttaaacagcactttaaaaagggcaggcacttttttgatttcttttccggggaatgcgatgatcaccgcagaaatcgtaccgaacaaaataatcagaatagctgccgggttagcgagtgcgcttaagctgacccctttcagcaccatgcccacgcttaaagcaatcactgcgaggatgataccgataatcgatgttttatccatagttttcaccaaatcctttatactagctttctatggttaatatcggtggcagtgcatggaactttagggtgattgaaaaattgttcccgaattcttcacagtttctcccttccggcatggagaaagaaacaaaaaagcagctccccgcgaggagggaaccgcttttttcttattgtgcccggactttgatgccgtcctcttccattacgacatggaaggctttgatttcgttgtcatccaatagaagatctgtcatttcgtcctcgatcaattcttggatggttcttctgagcgggcgtgctccgaaagcggggtggtagccgatttcagcgattttttccttcgcatcatcggtgacgctcaggctgatgccgcgctcttttaatgtgtcttcaagctctgtgagaagcaggctgacgattttcacgagatgttcttttttcagggattggaattcaataatgctgtcaaaccggtttaaaaactccggtttgaagaacgcgctcagtgaatcaatcagcgtttgttcttccatgacgctctcttcagattggaatccgactttcacctgtttttcgccggttccagcgttgcttgtcataatcaaaacggtatctttaaagctgaccgttctgccctggctgtctgtcagacggccgtcctccataatctgcagaaacatatgctggacatcagggtgggctttttcaatctcatcgagcagcacgatgctgtacggattgcggcgcactttttccgttaattgaccggcttcatcgtgtccgacatatcccggcggtgaaccgataatttttgatacggcgtgtttttccatgtattcactcatatcgagacggataatggaatcttttgtaccgaacagttcatctgcgagtgtctttgataactcggtttttccgactccggtcggtccgacaaagaggaaggagccgacaggtctgtttttggattttaaaccggcgcggcttcgtctgactgctttcgccacttttttcacggctttttcctgaccgatgacacgctgatgaagatgctcttcaagttccttcattttgacttgttcatcagcctggagttttccgaccggaatgcctgttttttgttcaatgatggcttgaatatgctccgcgccgatttcaggtgaagaggccggtgtttcatgcgccagctgcttttccaaagctgcttcttcatcacgcagtttcgcggcaagctcataattttcttcctgaagcgcttttgttttctccgcgtcaattgcattgagtctctcagccgcatcttcttcatttacggtatcaagttccaggttcgccttagagccggcttcatctaataagtcgatcgctttatccggcaggtggcggtcctgaatgtaacgggatgaaagcgtaacacaggcgtttatcgcttcattgctgaatgtgacgccgtggtatttctcgtatttatctttaatgccttccagaatgctgatggcttgttctattgtaggctcgtgaaccatgacaggctggaagcgtctttcaagcgccgcatctttttcaatctggcggtactctttcagcgttgtcgccccgatgacctgcagctcgcctctggcaagcgccggtttcaggatgttcccggcatccattgatccctcggcagagccggcacctacaagaaggtgaatctcatcaatgaacaagatgacatttttccgttcttttaattcgttcattaattgtttcattctttcttcaaactggcctctgatccctgtattggcgacgagagaagcgacgtcaagcaggtaaagctctttgtttttcaacttgttcggcacatcgccttcagcgattttaagcgcgaggccttctgcaatagccgttttaccgacgcccggctcaccgatcagcaccggattgtttttattccggcggttcaaaatttcaattacgcgcgccacttcattatcgcggccgatcacagggtcaatcagacctgcttttgcgccgtttgtgacgttttgagcgagctcgtcaagcaggcctttttcagggccggcctgctgtttattttgattgggagcgaaaccttgctcaaacgggaatccgaatgattgcggccccatgctcatagacggttttcgggttaattctgtataacatgtttcacataaaacgaattgtttttgaatggaattgacttgcatgttcaggcgaatcgtcgcctcgtttttctgacaatgttgacaacgcatttgccaaaacctcctcgaaaaatatttgatcatctttgaccaaatgggttagaaaataaggtcgaaactttgaccttctttgattattagtatactctgaccttctttgactttcaagtattttgtttcaaaccccgaaaaataaatgtttacagcatgataagtgatattcgtgaggtttgattatttttgaccaatatagtcggaaaggaaatgaaatgctttgacctttcttgatgaagagtatacgccggccctttttttctttcaatatttttgcttagaggagagagctgaatctgttttttccggggaaggacgatttgttcgtcttttcgggagacttgtctcataagcatatataaaggcctggacaaatctgcgtttagccggagggtgaaatgggacaaacaaaaggttctgcaagtcagcttgcatttgtatacgtaggcacggttgtaggagccggttttgccacgggacgggaaatcgttgagttttttctgaagtttggctggatcggtctgttcggtatcgtggtaagcggtctgatgtttacatatttaggcgccaaaatcatgattatttccaaacggattcatgcagcatcttatcaggaattgaacacatatttattcggccagtccatcggccgcgccgtgaacatgtttatgatgtttatattgctgggagtgacctctgtcatgctgtccggagccggagcgctgtttcatgaacagcttggctggcccgcacaagcggggatcctactgacgatcgtactgagttttgccgtcatgacaagcggtgttaaaggtgtgttcggcgtcaatatattggtggtgccgcttttaatttctttctcttttatcgtgacagctgattcatttgtatttacaagcacgagaaacgcggacgaatgggtatggcctgacaagtggaactggcttttgtccgccgtctcttacggcgcgttaaatttatcgctcgcccaagccgtccttgtgccgcttgcgaacgaaatgtcttcagagaaggtgatcagaaggggagcttatataggcggcgttctgttgacactggtgcttgccgcgagctttttatcattatcggtgctgccggatgtgctggagtttgacattccgatggctcaagttgtctattcgtattcgcgttcgcttcatatcatttatttgtttattattttcggggaagtgtttacgtcggttatcggcaatttatacggattggaaaaacaattaaacagttttcttcatataaaaagtacatatatttacggcggcattttggcgtttgctttcattatcagccaaatcggttacggacagctgatttccaccgtttatccggtgtttgggtatgtgagcctcgcttttatgggcgcattgatttgcaaaaaaatcccgaaagaaaaataaggaaaatgtctgtatattttgggaattcccttcttttttcctgccatttctgtataatgaattgggaaatgatggggaggagtaagagatgaaggatcgacgtgtattattgggatttatttttatttgtatcggcattacgttttttttacagaaggcgggagttatacatatatccgcaggttcggcgtggccgtttcttttcattataatgtccgcagggtttcacgccggatttatttttgcgaaaaaaacgcctgaacaggcgggactgctcgttcccggcggtatgtttcttgtgctgggctgcctgttttgttttgagaccgcaacgggatggacgtattcaggcatgacgtggcctgtttatatatgggcgcctgctctcggtctgtttgagctgtggtatttcggcgggagaaagatcggcgtattgattcctgcttttatcctgacagccgcgggagcactatgctttgccggtatgctgatgacggggctgtggccgcttttgatcatcgcagccgcgcttttgtttcacgccgctgcctttatgcaaccgaaaaaaagatcgggccttcttattccgggcggcattttgcttgtgacgggcggcttgttatggtttgaaacgctgacggattggacatacgcaacgatgacatcgcctgtttacctctttgccgttgcattcgggctgtttgaagcctggctgttcggcagaaggcaaagagggcttttgactgctgcggcggttctgtgcgccgcgggcattttcggcatattcaccaatgcaaatgaagtcatcagcgaacgcggctggcccgctctcattctgttgctgggcgccgcttttcacattccgattttcggcccgaaacctgtcaaaaacgcggggcttctcgtaccgggcggcatcttattgatcacggggatcttgtttgtctttgaaacggcaaccaattggttctactccgatgtgacatggcctgtttacctgttggcaacggcattcggtttatttgagctgtggctgttcggcgggaaacagaaggcgctgctcattccggttgcagtgctgaccttgacagcactttgctttatgatgacgtatcagccgatcattccggtttctgttttctggcctgctttatttgttctgatcgggattgcgctgatggcatttccggggaagaaacgcggggcttaaacccgcttttgcagcctgacacagggttcaggctgtttttttattgtcacgggaaacaacattatggtatgatagcaaaagtgaaaaaagaagaaaatccgtattgatgcgggagaggttctagctacaccctctataaaaaactaaggacgagctgtatccttggatacggtttttttatgttttttagggcgccttctccgaaaaaggcgctttttttatggaatgatagataagggagagaaagacatgaaaaaagaaaaagcggttgtggtgttcagcggaggccaagacagcacgacttgtttattatgggctttgcaaaactttgaagaagtggaaaccgttacattccattataatcagcgtcaccaagaagaaatcgatgtggcaaaatcgattgccgaaaagctcggtgtcaaaaaccacttgcttgatatgtctcttttaaatcagcttgcgccgaatgcgctgacaagagatgatatcgaaattgaagcgaaggacggggaattgccgacaacctttgtaccgggacgcaaccttgtatttttatcctttgcatcgattcttgcatatcaaatcggcgcgcgccacattattaccggtgtttgcgagactgatttcagcggctacccggactgccgtgacgagtttgtcaaatcctgcaacgtcaccgtcaacttggcgatggaaaagccgttcgtcattcatacgccccttatgtggctgaacaaagcagaaacgtggaaacttgcggatgagctcggcgcgcttgattttgtaaagaataacacactgacttgctataacggcatcattgcggacggatgcggcgaatgcccggcatgcctgctccgcaataaaggatatgatgaatatatgaaaatgaaaggagagcggaactaattgctttctcaaatttacccgcaggttcagcatccttattcgtttgagttgaataaggacatgcacatttcagccgcgcactttattccccgcgaaagcgccggagcgtgcagcagagtccacgggcacacgtatacagtaaatattacagttgcgggggatgaactggacgattcaggctttctcgtgaatttcagcgtgctgaagaaattggtgcacggcgcttatgaccatacattgctgaatgaccatgaggaattttctgatgatgacagatattcactgccgacgaccgaggtcgtagccaaaacgatttatgataaggtgcagtcctacctcgaaacactggagaatcagccggtctgcgtgcaggtttttgtcagggaaaccccgacaagctattgcgtataccgcccgaaaaaaggtgataggaatggctaaaggaattccggtattagaaattttcggaccgacgatacaaggggagggcatggttatcggccagaaaaccatgttcgtccgcacggcgggctgtgactactcctgcagctggtgcgactccgcttttacatgggacggatcagccaaaaaagatatccgctggatgacggcggaagacatttaccgcgagctgagagaaatcggcggagacgccttttctcatgtcaccatctcaggaggaaacccggcgctgttaaagcagcttgacgcgctgattctgctgctgaaagagcacggggtgcgcgccgctttagaaacgcagggaacagtctatcaggattggttcacaatgattaacgacctgacgatttcaccgaagccgccaagttcggggatgacaaccgattttgcaaagctcgatcatattatgtcttcgcttgatgcggcagaaaggcttaacgcggtcagcttaaaggtcgtcatttttaatgatgaagatctgcaattcgcgaaaaccgtgcacaagcggtatccgaatatcccgttttatcttcaggtcggaaacgataacgtccatacgacggacgaccgggcattgatcgcacatctgctcggaaaatacgaaacactcgttgataaggtttcagccgattcggatctgaatctcgtcagagtcctgcctcagctgcatacgctgctttggggcaataaacggggagtttaatagaaagggagatttatatgacaagaaaagaatcagaattagaaggagttacgctcctggggaatcaagggacaaactatttatttgaatatgcgccggaggttttggaatcatttccgaataaacacgtgaaccgtgattatttcgttaaattcaactgcccggaatttacgtcgctttgcccgaaaacgggacagccggattttgcaaccatctacatcagctatattccggatgaaaaaatggtggaaagcaaatcgttaaagctgtatcttttcagcttccgcaaccacggagatttccacgaggactgcatgaacatcatcatgaatgacttgatcgaattaatggacccccgctacattgaagtatggggcaaattcacgccaagaggcggaatctccattgacccgtatacaaactacggcagaccgggaacaaaatacgaaaaaatggccgaacatcggatgatgaatcatgatatgtatccggagacgattgataatcgttaatttcagacggagtacggactcggactataacctaaatacccccgccttttaagcgggggtatttttcgtctctgccacgcagccaaaaaggtgcatgatatttgcacagaacttctataaggaaaagagagatcatttggagaaaagaaaaagacgagtaaacccggggggagtgtactcgccgcttcaatacgtgacgggtgctggatggcagctcgtctgtttcattataaaatagggaacgtatgtttgtaaaggactgcgctgttttttcttattcggagcggatcaattgtaaaggaatggccagcatggtagcatgtcctgtaaaaagaaggagtgttcgttatggagccgttagagttaaacggtgtaaggctgaaaatgtatgattgtaaagaaagtgcgggtaaaaacggccgtatgatttcattcgtattgaaggtgacctctgaaacgtatcatgatattgccgtccttttgtatgaaaaaacatttgacatcaaggcgcccgagcgtgggcttgaattccgcggtaaaataaccaactactatacatccgtcacaaatctttacaataaagatgagaccgatgatttttttgtggaaatgaccgagatctgaattcatttgaaaaagctgccgggcggcagcttttgtgcgggatatgtaaatggttcggattgttcgggggtttaataggagtctctgatgattttataattcttatggttgacgacagtgagggaatctaattcaaggtcacgataattatccatgatggttacatcaacgatgacggagttttcatttactttttcaacaataccggttaatccgtttttaaattcaatgacgtttccaaccttagcaattttcacgagcttcctctcctttatcataaatcctgtttgaaaatattttgcagtattttctttaagaagtaaagcgatatgggtatcagcccgctcaatcattgtcccggcgggggaaagatggtatattgtttttcgggaaaaagccgagaaaaggaggctgtattcgttgctgcctgaggaaatttcagaacgtatcaaccaaatgcgcatcggtgaaatcaaagaattcagggtgcagaaagaacattttcttgcatttcgagcggttttgtcgaagcaggaagattttaagcatttccgcggtattgcccagcagggcggagatgttatcttccagtatttagaacagccaagaagctgacggctcctcgcacttgaggagtctttttttgttttcgctgcttatttcatctggctgtaacagatgtaaacaaaatgtaaaatccctccgatggatacttttactgctatttggttaatgttgtgaaaatgacggctgttttcctgccaataacaaggctgttaacaaacttcttccatcataaaagctgattgggagcattggaaaatctttaaccgtgaatttgcgtacagctcttgttaaggtagtgaagtatttaaggaggaaatcgtatgacgacaaaatttgctgccttggctgtcttttttctatgttttatgcctgcatcaaaaattgaacatacagaagctctgtttacttttgcgaagaagccaaagcaagaacccagcacactggttgctgatttaaataaaaaaagcccggttccgaagctctcagaaacggatcataagcactctatccaaccgataaagctgtcatctcaccaagagaagaaagcaaaaccggacgagacggcttatcagccgccgaaaaaaacgtattcccgcgctgacagacagctcctgtcacgtctcgttcacgcagaagcgaaaggtgaatcttataaagggaaggttgcggtagccagcgtagtgctgaaccgtactgaaaaaaacggtttcccggataccattcggggcgtgatctatcaaaggaatgcatttgaaccggtagcaaacggaagcattaatcaaaagccggataaggattccatcgccgccgcaaatgaggcgctagaccatccgggcagagaaacgaacgcgttgtttttctacaatccgaaaacggcatctgaccactggatccgttcccgaaaaattatcgaacggatcggcagacacgtatttgcgatgtaagaagcatagcgggataaaaaatatccccgctatgcttttttcaattttgagaaatcgaaaatattttcagaacttgtctcatatgatgatggaagaacgtgagacaaggagagacaccatgaatcgatttgtgaaagggatcattcttttatccatcgccgcctttttcgcggaatgtctggaatttgtcgtgaatatgatactggcgcgggagcttggcgagcatgggatggggctttacatgagcattctgcccaccatttttttaattatcgtgatcgccagtctggagcttccgatctctatttcaaaattcatcgcggaatccaatcagaagctgcatgaaagcatgcttcggcatgccttcagaatgaccgccgtttttaccgcgttttcaaccgcggccgcaagcatcgcgctgccgttcattcctgtattcgatacgtatcacccgtttattaaagggattgtcatcgggctgattccagtcgtcgcttttacatccatcgccagaggttattttatgggtgtgcagcaaatgggaaaaatcgcggttgcgaatgtcttgaaaaaaatcattcaagtgctttgtctgtttatcttttttcaatggtactcttttgaaattgatatggccgtgcttatttcgttatttgtgctggtcgcaagcgatgttgtggtgttcgtttatctgtatacgcagtttattttggcgcggagggcgctttccggccatcagcacattcatcttcgcgggaaagacgtgcggaaacgcctcctggccgtatccatcccgacaacgggacttcgtatatttcatgcggtgacaaacgcaattgaacccttcttggttaaaggagcgctgctggcgtccggggcagccgggaccgccgcgattgatcaatacggaatgcttgccggtgtagcgatgacaatcggttcgtttcccgcatttatcgcccattcgctgatggtcgttatgattcccagcatttcagaagcgtatgcgctgtcccaatatgatattgtgctgaaacggctgagacaagcgatttttattacattcggctacggcattccggcggtctgggtcatgtttcagttcgcgggcccgctgacccatttgttttttcagtctccggaagcgcagtattatttgcagcttttgtggccgttttttctttttcatctgtttgtgatgccgcttcaagcctgtctgatcggcatcggccacgtgaaaacggcgttttatcataacgtatggagcagcattgtaggtctttcaatgatgtatgtgctcggttctatgccggaattgcaaatgctcggcattatactcggtatgaataccggcatgattcttctgacaagtttacattacgtgacgatctgcaaagacctcggtgtctccgtgtttttgacgggcggcggaagaacagctccccggatcgaaagctgaaaaggctgatacatttcaataaggaagggcaagctatccgaaacgcgtgaaaggaagatcatatgcataaaaaccgtctaattgtatgtgcagtccttttgatagctgccgccgtttggatgcctgaagcaaaagcctcatcagaaaaacaggcagttcccgccgtgtttctgatgaagacgattgaaggagacgaaatatcgattccgaataaagggcagaaaacgattttgcatttttggacatcgtggtgtccgccgtgcaaaaaagaactgccgcaattccaaacctattttgaacagcatcagtctgatgatgtaagccttgtaacggtaaatttgatgaatgccgagcgaaataaaaataccgttcaaaactttgtcactcagcaccatctcacattcccgattgttcttgacacgaaaggcgagcttatgaaggaatacgatgtcatgacgattcccacgtcatttctgctgaatgaaaaaggagaaatcgaaaaaaagatcgtcggtccgatgaccgcctcacaattaaaagaatggtcagagaaataaaaaggtgcgggaggaattcctcccgcaccttttttgcatataatgaacagctgaagaaacactaatgataattattatcataaagaaattaaaacaattataattgaaatcttccgccggcatgctataataaagaaaacactgcgataacactgtgaaaatgctgcctgtcaggcggctgttttacttttatcagggaattgaagatgatttgcgttctcaattagagaggagaattcataatgaatgaacaagtgatgacacaaacccattcacaacagcagaagatacaagaagagcgggccggaaaaaggtggctccagcatgcagaactcattgcggcgctcgtatccggcgtccttattcttgcggcctggttttttaccgaaacaaaaggcctgtccgtcactttgtatatccttgccttcctgatcgggggatttgcaaaagcaaaagagggaattgaggataccattgagacgaaggcgttaaatgtggaactgctgatgatatttgcggctgtcggctccgccctgatcggttattgggcggaaggcgcagttcttatctttattttttcgttaagcggcgcgctcgaaacatatacgatgaataaaagcagccgtgatttaacatccttgatgaaactggaaccggaggaagcgaccctgcttgcggacggacgggaaaagcgggtgccggctgctgaacttaagatcggtgacatgatcgtcattaagccgggcgaacgcgtagcggcagacgggattattgagtctggcgtgacgagcctcgatgaatcggcgctgacgggtgaagcgatgccggcggaaaaaacagcaggagattctgtgtttacaggaacggtaaacggaaacggctccttaacggtccgtgtgacgaaaacaaatgaacagtctttattcagaaaaatcatccggctggtggaatcagcccaaaacagcgtgtcaccggctcaggcatttattgagcgattcgaaagtgtctatgtcaaaggcgtgctgttagccgtggctgtgcttttattcgttcctcatttcgctttaggctggagctggagtgaaaccttttaccgggcgatggtgtttatggtggtcgcctccccgtgcgcgcttgttgcttctattatgcccgctgcgctttcccttatctcaaatggggcccgcaacggattattggttaaaggaagtgtgtttttagagcagctgggaagcgtacggatgatcgcatttgacaaaaccggcacggtcacaaagggacagccggcagtcgcggcatttcaagcagcggaaaatgtgagtgaagatgagatcatgcaggcggtatatgcgatagaaaagcaatcaagccacccgcttgcaaaagcgatagctgaatttgccgaaagccggggcgccgcgcccgcaggccatctatcgattgacgagacgtccggattcggtgttcaggctgaaatagaaggcgtcaaatggatggtcggaaaagcgggatttgcaggtgaacatgcggcagatgcttttttgcagacatcgggaaaagaattaaaggataaaggctttacactggtttttgttaagaaagaagaccggattgcgggctgcttcgccttaaaggatcaaatccggcctgaagccaaagccgtgatggctgagcttgaatcactgggcattcaaacagccatgctcaccggcgatcagtctgaaactgcggctgccatcgcgaaagaggcgggcatgacgacggttgttgccgattgtctgccggaccaaaaggcaaaagaagtgaagaagctgaaagaaacgtacggcacaatcgccatggtcggagacggcattaatgacgcgcccgctctgaaaaccgctgacgtcggtattgcgatgggcgggggcacggacgtggctctagaaacggctgacttagtccttatgaaaaatgatcttcacaagcttgtgaaaatgtgcagactttcaaggaaaatgaaccggattattaagcagaatattgttttctcgctctcggtcatctgccttttgatctgcgctaactttctgcaggtgatggaactgccgtttggcgtaatcggccatgaggggagcacgattctggttatactgaacggactgagattattaaaataaacatgacagccgcacatcgggcggctgtttttttaatgttcgttcacagcataaacgccggaaaactgatagaatgaataaagagtcactttggtaaggaggaaaatcaaaaaatgaacagattagaacgtgtttcatcttggctgaaaaaagaaggacatgatgcggcgtttatacatacaaaggaaaacgtattttatttaactgatttttacacggatccgcatgagcggttaatgggattgttcctgtttcaggaacaggagccgtttttcgtttgtccgggaatggaagacggacaagcccgaagcgccggttgggagcatggtattatcggctacggcgatcacgaagatccgtgggagctgatcaaagccgagctcacaaaacgaaatgtgccgcttgattccatcgcggttgaaaaggattcgatctctctttcccgctcagaacagctcaaacaagcttctgggggcgcggcatttgtttcggcagaagaaacgctcaaccaattccgtctcgtaaaagatgagaaggaaatcagcattctcagggaagcggcaaaactcgcggattacggagttgaagtcggtgtcgcggcgcttaaagagggtgtgagtgaaaccgaagtactcgcgcagattgagtttgagctgaagaaaaaaggtgtgcagggcatgtcattttcaacgatggtgctgttcggggaaaaatcaggccagccccatgggaatccgggtgcagaccggttgaaaaaaggggattttgttctgtttgatctgggcgttattcttgacggctactgttcagacattacgagaacattcgcataccaatcaatcagcccgaaacaggaagagatttacgaaacggtgcttaaagctgaacagacggcgcttcaattaagtaaacccggcgtcagaatcggcgatcttgatttaaaagcccgcggcattattgaaaaagccggatacggagactatttcccgcaccgcctcggccacggactcgggatttcggttcacgaatatccatcaatgagcagcgcgaacgacacactcctcaaagaaggcatggtgtacacgatagaaccgggaatttacgtgccggatgtcggcggcgtgcgcatagaagacgatgtgtttgtcacaaaagacggcgccgaagcattaacgcagtatccgaaagaattaacgattctgaaatagaaagctttgtgataaaaaaggacggttctggaacgcagcgtccttttttatcaccttttaaatgaaaaaatcatcaaaatgctgaaatggtttgatgtcatgcttttcattcaggggccgcagggcaaggtaactgccgccgagtatggccagacacaaaccgattaagcaaagaatccccatcgctgttcttctcctttcaaacggataggatgtatctgtttctagcttactgtatgaaacgcattccagatcaagggaaaaaaagaaaggggggacgccatggctacgatcagagacattgccggcgctgccggggtttccgttacaacggtatcaagagttttaaacgatcatccttatgtaagtaaggacaaaagagaaagagtgaaaaaagcgatgcaatcgctcggatacacgcgcaacattcatgctgttcatttatccaaaggtttttccgatatgatcggcgttgtgcttccgtcggtgaaccttccgtattttgcagaccttgttgcaggtattgccgaggctgccgaagcgtcaggcgtgcatctttgtttataccagacagattatgagcagcaaaaagaacgttttgccttatcacaattacaggagcgccaagtggacggcctgattatctgctccaaagcaattcctgatgagcatttgcttgccgtgaaagaaccgctcatcctctgccagtacactgatgcggcagggctttcctccatcagtaatccacatcgggaagcatttcggcacggtctggattatctgatagaaaagggacaccggaaaatagcgatctgcctggccagaaaaaagggaaaaaacagtcaagtccgaatcgccgcatacaaagaggcgctgaagaagatcgggcagccttacagggaagagctggttgtggaaaaggtgctgacgctgcttgacgggaaagccctttttcatagatggaagagctgggatgacaaaccgactgcgctgtttgcggcgaatgatcaagtatccgcaggtctttaccttgaagccaaggcaaacgggacgcgcatcccggaagagcttgcgattttgagcatcgacaatcatgatatcagcaagatgttaggtatttccacaatagatatacaaacgaaagaaatgggaaagcaggcttttcacatgcttgagaaccggatcagcggcgggcctccgggaaggaaagttcttgattaccgccttattgaacgatcaaccgtctaaaaaaagaattgacgcgctttccgttcgttttgtacgatatgaggtattgaatgacaaaggagctgaggatcatgaaggggtcctttacagttgaaaaggtattaaataacaatgtgctcatcgcaacacatgatagatacagtgaggtcgtcttaatcggaaaagggatcggctttggaaaaaaacaagcggatgtcattgaagataaagggtatgacaagatgttcatcttaaaggatgaaaaagaacaaaaacaatttaaaaagctcctcggttatgtggacgagacacttgtcgacatctccaatgacgtcatttatcatatcaagaagcggacaagccaaccgttaaatgagcatatccatattgcgctgactgaccatatcgcctttgcggtaaagcggctgcagcaggggtttgacattaaaaacccgtttctcatggaaaccgaaacgctttatccggaagaattccaaattgcccgtgaagtcgtcggcatgattaatgaaaagacgggaatctgccttcctgaaggagagatcggctttatcgctctgcatatccattccgccctgacgaatcggcccctttcagaggtcaatcagcattcgcagctgatgtcccgccttgttcaggtgattgaggactctttccagatgaaagtgaataaagaaagcgtccactatttgcggctgatccggcatatcagatttaccatagacaggattaatcgggaagagcagacaaaagaaccagaaaagttaatgttattattgaaaaatgaatacccgctatgctacaatactgcttggaaactgataaaaatcttgcagcaaatactgaaaaaaccagttcatgaggcggaagcggtttatctcacgcttcatttgtaccgattaaccaataaaatttcataatttcagttgaaaccttaaaaacgtgtcactgattcgatcaggcatgagtgattgagggtaaaaaacgggaagaacgatcccgttattttgcacaccctttttactcatgccttttttgttgtgtaaaagggcaaatgtaaacggttaaactgaagacttgcgccagtgaattcgttgtcatgaattttcgctgtaaggtcacactagctaacagaggaggtacatcttttatgtttaaagcattattcggcgttctccagaaaatcggccgtgctcttatgcttccggttgcgattttaccggctgcggggatcttgcttgcgttagggaatgccatgcagaacaaagatatgattcaagtcatgcatttcttaagcaatgataacgttcagcttgtggcgaacgtcatggaaagcgccggccaaatcgtatttgacaacctgccgcttctttttgcagtaggggttgcgatcggtcttgccaacggagacggtgttgccggaattgcggccattatcggatacctggtcatgaacgtatccatgagcgccgtgcttatggcgaacggcagtattccgtctgacaaaattgaacgggcaaagttttttgcggaaaaccatccggcctatattaacatgctggggatacccactttggcgactggcgtgttcggcggtattatcgtcggggtcctggccgcgttattgttcaacaagttttataaaattgaacttccgcagtacctcggattctttgcgggtaagcggttcgtcccgattatcacatcaatttccgcattaattctcggacttattatgttagtgatctggcctccgatccagcacggtctgaattccttctccacgggtcttgtggaagcgaatccaaccttggcggcctttattttcgggatgattgagcggtcattgattccgttcggtcttcatcacattttctactcgccgttctggtatgaatttttcagctataaagatgcggccggagacatcatccgcggagatcagcggattttcatggctcagatcaaagacggcgtacagctgacggcgggaacatttatgacggggaaatatccgtttatgatgttcggtcttccggcggcagcgcttgcaatctatcatgaagcgaagcctgaaaagaaaaaacttgtagccggaatcatgggttctgccgctctgacaagtttcttaacgggaattaccgagccgcttgaattctcattcttatttgtggctcctatcctgtttgcgattcactgcgtattcgcgggactttcctttatggttatgcagctgctgcatgtaaaaatcggtatgacgttctcaggcggtctgattgactacttcctgttcggaattctgcctaaccggaccgcttggtggcttgtcattccggtcggcctaggattagccgttatttactacttcggtttccggtttgcgatcagaaagttcaatctgaaaacgccgggccgtgaagaagaggctgcggatgaaggtgcgggcgcctcaggcgaagccggcgaccttccttatgaaatcctgcaggcaatgggtgaccaggaaaacattaagcaccttgacgcttgtatcacgagactccgcgttacggtcaacgaccagaagaaagtggataagactcgtttgaaacagcttggcgcctcaggcgttcttgaagtcggaaacaacattcaggccattttcggcccgcgttctgacggtttaaaaacacagatgcaggatattatcgccggacgcacgccgcgccctgaaccgaaagtatccgcacaagaagaagtcagccagcaggttgaggaggttatcgcagatccgctccgaaacgagcagggtgaagaagtgttcgcttctccgatcaccggcgaaatccatccgattaccgatgtgcctgaccaggtgttctcaggaaaaatgatgggtgacggttttgcgattcttcctgaagaaggaatcgtcgtatcgcctgtccgcggaaaagtgctgaatgttttcccgacaaaacatgcgatcggtcttcagtctgacggcggaagagagatcctgattcatttcggaatcgacacagtcagcctgaaaggcgaaggattcacttcttttgtttcagagggtgaccgggttgaaccggggcaaaagctgcttgaagttgatcttgaagcggttaaacctcatgttccttcattaatgacaccgattgtctttacaaatcttgccgagggtgaagcgatttccctttcggccgaaggtaccgtaaaacgggaacaaaaagatattgtgaaaatcggaaaataagcatataaatacgccgtgcttgtcagatgacaagtacggctgtatgatataatattgtgtagtaaaatagctttaatttaaaggagaatgataatcatggcacaaaaaacatttaaagtaacagcagattccggaatccacgctcgtcctgcgacagttcttgtacagactgcaagcaaatacgatgctgacgtaaacttagaatataacggcaaaacagtaaaccttaagtcaatcatgggcgttatgtctctaggtatcgctaaaggcgctgaaatcacaatttccgcttcaggcgctgacgaaaacgatgctcttaacgctttagaagaaacaatgaaaagcgaaggactcggcgagtaatgcaagaattaaaaggaataggcgcttcagccggaattgcgattgcgaaagcataccggcttgaagagccggacttaacggttgaaaagaaaaacattgctgatgctgcggctgaagtaagccgttttgatgaagcgattgtacgttctaaagaagagcttgaaaaaattaaagagcatgctttaaaagaactgggacaagacaaagctgacattttctccgcgcaccttttagttctgagtgatcctgagctgctgaacccggtaaaggagaaaatcagcacagattcagtcaatgctgaattcgctttgaaagaaacagcttccatgttcgttactatgtttgaatcaatggataacgaatacatgaaagagcgtgcggcggatatccgtgacgtaacaaaacgtgtgacggggcacctgctgggcgtggaaattccgaacccgagcatgatctcagaagaggttgttatcgtggctgaagatttgacaccgtctgatacggcgcaattaaaccgccagtttgtaaaaggttttacaactgatatcggcggacgcacttcacactccgcgatcatggcccgttcgcttgaaattccggctgttgtcggcacaaaagcggctacagggacaattgaaaacggtgttacggtaatcgtagacggcatcgatggtgatgtgatcatcgatccttccagtgaaacgttaaagaaatatgaagaaaagcacagtgcttacctggcgcaaaaagctgagtgggcgaagctcgtcaatgaaccgactgtttcaaaagacggccatcatgtagagcttgccgcaaacatcggcacacctgacgatgtaaaaggcgttcttgaaaacggaggagaagctgtagggctttaccgtacggaattcctttacatgggacgcgaccagcttccgacggaagacgagcagtttgacgcttataaaacggttcttgagcgtatggaaggaaaatcagttgtcgtgcggacattggatatcggcggcgacaaagagcttccttacctgcagctccctaaagaaatgaacccgttcttaggctacagagccatccgcctttgccttgaagagcaagaaatcttcagaactcagcttcgtgcgctgcttcgtgcaagtacatacggaaacttaaaaatcatgttcccgatgattgcgacagtaaacgagtttaaacaggcgaaagcgattcttctcgaagaaaaagaaaaactcgtcgaagccggcgtagcggtttctgacgatattgaagtcggtatgatggtagagattccgtctacagccgttatcgcagatcagtttgctacagaagttgacttcttcagtatcggaacaaatgacttgatccaatacacgatggctgctgaccgcatgaacgagcgcgtagcttatctgtatcagccatacaacccggcgattctccgtctgatcacccttgttattgaagccgctcacaaagagggcaaatgggtcggaatgtgcggagaaatggcgggagacgaaattgcgattccgattcttctcggcttaggcttagatgagttctcaatgagcgctacatccatccttccggcaagaacgcagatcagcaagctttctaaaaaagaagctgaatcattcaaagaaacaatcttgtctatgagcacgacagaagaggttgtcgcattcgttaaagaaacattcaataagtaatacaacagccagacggtataagccgtctggtttttttcatattcggaaaaaagggggaacaataacgttcaacaggagggattattatgacaaaatcatttgcagcgggggatacggtctatgtgatttaccgcaatccgcatgccgccaatgttgcccatattaaagaggcggagatcgtccatcacccatatcatgagggagaactgtctctgtttttatacgaaacctatcatccgctggccgaagatgacgcggtcttttcaacatatgaggaagcggaagcgctttacagcgagctttttgaagaagaccgatatcattgatcaaaggaaatgtttacaacgcatattcactctcttttaaacggaaagtaacaacatgagaatatgaaaaaagggagtgtcagttcatgctgaagccgtttgtgccccagcttgtttatatagaaccgagagcgctcgaatacccgttaggacaagagctgaagaataagtttgaaaatatggggcttgagatcagagaaacaacatcgcataatcaagtccggaatattccggggaaaaatcacttgcagcaataccggaacgcgaaatcaacattggtaatcggcgtccggaaaacactgaaattcgattcttcaaagccgtccgccgaatatgccattccatttgcgacaggctgtatggggcattgccactattgctacctgcagacgacgatggggtcaaagccttacatccggacatatgtcaatgtagaagagattctggatcaggctgatgagtatatgaaagaacgagcgccggaatttacaagatttgaagcctcttgtacgtctgatatcgtcggaatcgatcatctgacacatacattaaaaagagccattgaacatttcggacaaagcgaattggggcagctcagattcgtgactaaatttcaccacgtcgatcatttgcttgatgcaaaacataacggaaagactaggttcagattcagcatcaatgcggattatgtcataaaaaactttgaaccgggaacttctccgctcgacaaacggatcgaagccgccgtcaaagtcgctaaagcgggctatccgctcggtttcatcgtggcgcctatttatattcatgatggctgggaggaaggctataaggagctgtttgagaaactggatgcggcgcttgatgaagacgttcggcatgacatcacatttgaactgatccagcatcgttttacaaaaccggccaaacgggtgattgagaagaactatccgaaaacaaagcttgagcttgatgaagaaaagcgcaggtacaaatggggacgctacggaatcggcaaatatatataccaaaaagacgaagaacatgccttaagggaaacactcgaatcttatatcgaaacctattttccgaaagcgaaaatcgaatattttacgtaaggcggagctgtcggcatgacggctcttttttttgctgcgacaaatgacggaaatgtttgatatttatttcaagatttattcattttcttggccgaaagaccgatataactctcaggaggggatggttatgtttaaaaaaatgcatatcaaaattgctgtgtttgtatcggcaatgcttattgtaacggttgtttttttaacggtttcttcatatttgacattaaagccgatgatgacggaggaagcaaaacgtacgacagagaatgtcaccaattcactcggtcagaacattgagcttcagctgaaaaatgatgagaccgtattaatgagattagcagacggtgaattgtcccggtcttttctatcagatgggaagaaagaaaccgcgcggctttttaacgatgagttaaaacagatcggacagaatgacaaatatgtcgcgcttgcgtacgtcggaaccgcaaacaaacaaatgtttacatatccaaaggccgattttgccaaagactatgatctgacaaatcgaacgtggtataagatggcggctgaaaaacccgataaggttgtctggactgacccttataaagatgcagtgacgggagacatgatcgtgacggcgtcaaaagccattcaaaacagcggaaccgtcgtcggagtggcgagcttagatttgaagctgtcctccattcagagcatggtcaacgagcaaaaggttccgtataaaggatttgcgtttttggcggatgaaaacggctctcttctggcccatccggcaaaacagggaaaaaatatttcggaagatcagacgttaaaagacatcactgcggacaaagaaggcatcaaagagctgcaggggaacatggtcgtctaccaaacggtaaaagaaacagggtggaaagtcggaacgcagtttgaaaaagatcagctgatgggagtagccgacaaaatgaacacggtgagcatttttatgtcactgatcgcccttgtgattacgatcggactcagctatttcctcgcaaaaacgataaccgggccgattcagcagctgatcgcaaaaacaaattcagtctcagcgggagatttaaccgtccgcgcccagacgaaatcaaaagatgaagtaggcgagttaacaaaagactttaaccaaatggttgaaaatatgaaagagatggtcgaacaggtcaaggcctcctcagaaaatgtgtctgatacatctgaccagctaaccgtcatttcacaagaaacaaatgaaacgagcggacaaatcgcaaaagcgatagaggaagtcgccgccggagcgacagagcaagcgtcagaggttgagacgatcaacgaaaaatcagaaaatctctcagtcaaaataaaaggaatcgcagatcgcgcaggcagcataaaacaactctcaaaatcttcagaggatgccagctacaaaggattggacgcgctcgggcagctgctgatgaagtcaaacgaagccaattcagaaacgaaaaaagtagaggcaatgctgaatgacctggaagaacaaacgaaaaacatagaagaagtcgtgacggcaatatccgctatttcagaccagacgaatctcttggcgctgaatgcgagcatagaagccgcaagagcgggagaaagcggacggggctttgccgtcgtcgcggaagaagtccgcaagcttgctgaacaatcagctctttcttccggccatatcagtgagacggtccgtctgattcaatctgagacaaaagaagcgtcacacgcgatgattgaggcaagcagaatgaatgatgaacaaaacagcgccattcatgaaacgggtgaggttctcaatctgattacaacggaaatgcagtctctcgttcaaggtatagatcatatttacaatgacattcaaaaaatgagtgaagaacaagcctcgattcaagaagcgattcaaagcatctccgccatttctcaagaatctgcggcagcggcggaagaagtgaatgcttctactgatgaacagctcgttacgcttgaaaaagtgaagcaatcgactgatatgttaaagagcgcaagcgaagatctgatcagcgccatttctaaattcaccttgtgacgcggtctctatcagcctataatatggtaatatagacatgaaagagtgatatatgaatcgcatcaggggaggaaagcgcagtgaacaaaacggtaggatttatcggtttgggcgtcatgggaaacagtatggcatcgcacattttagaagcgggctatcctgttttagtctacacgcgtacgaaacacaaagcggaagaggttctgaataagggagcggtctggcaggagacggtcaaagacctttcggaaaaagcagacatcattattaccatggtcggctatccgagtgatgtcgaggaaatctatctcggtgaaagcggcattctccgtcatgcaaaagaaggggcgtttgtcattgatatgacgacatcaaaaccatctctggcgaagaaaatagcggagaaagccaaagaaaagtccattcacgccctggatgcacccgtttccggcggagacatcggcgcgaggaacggaacgcttgccattatggccggaggagaaaaagaagcgtttgaagcatgcctgccgcttttctccgttatgggggaaaatattcagtatcaagggccggctggcagcggccagcatacgaaaatgtgcaatcagatcgcgattgcagcggggatggtcggagtggctgaagcgatggcttacgcggaaaaatccggtctgaacccggaacaagtgctgaaaagcattacaaccggagcggctggcagctggtcattgtcaaacctcgctccccgtatgctgaaaggcgattttgcgcccggattttacgtgaaacactttattaaagacatgggcattgcccttgaagaagcggagctcatgggagaagaaatgcccggattggcgctggccaaatcattgtacgacaagctttccgcgcaaggtgaagaaaacagcggaactcaaagcatttataagctttgggtgaaataaaaaaaagattgcccgccgggcaatctttttttatttattttccgatgaattgctgtgtccagatgtttcctgattctacataacccacaccgatttgagtgaactcaggattcatgatgttctttctgtggccttcactgttcatccaagctttaacgacggcttcaggagtcgtctgccctttggcgatattttcaccggcagttttataagtgattccgaaagacttcatcatatcgaaaggtgagccgtaagtcggactttggtgatcgaaatagtttttgtctttcatatcttgtgattttgcgtgagctgatttgcttaatttttcatcaatctgcagaggttttaagccttgcttttgtctctctgcatttgtcaattcaacgactttcttttcatacgcactgactgatgaaggagttttctcgctgctgttgtttgtattatctgtctgctttgcattgtcagccgtctggttttgatcggctttcggtttttcggcagctgtcggggccgttttttccggtgtttctttttgaacgtctttaactgtcatatcagaatgctttgcgtgtttttgcagcagctgagtcagttctttctcatttttaacgttcagctttttcacgctcgttttcatatgtagtttttcaacagcctcttgaagagtcagatgctgtacggtgtttccttttttcacagtaacgacgtgctggcatgacagctcttttgcagatgcctgctgaatgcctccgaatgtaatcaaactgactgccgcggcggcagataagagaaatgcttttttcataagtttatagcctcccagagaagttgtttttttctacatgaaaaatcttatcacagcttttttgtcataatgcaggcagccatttcctttgacaacaaacgtttgtcataattgtaattgagcacagaaaaatggctttatatcagtaaaaacgatctgtatttattttttaaaatccgttacatctcttcaaattatttgaagtgttagatatattttaagataatttgatcttgacagttttttttacccgttttcgctgtaacaacttttacaaaaatgttacaattaaaatctgtttatgtaaatatattcaatgatttgagaggtgtaacagaaagtggctgaagtcgcgcgcgaaccaaagaaaaaaacgaaacgttacagagcgctgagaatgaatctctattttttgattgtgtttcttctctttacggcactgatttttaaactcggcatcgtccagattgtcgaaggggataaacaccgccaggatgcggagaaggcaaatgcaaaaaccgcctattatccgacaccgcggggaaaaatgtatgacaagcggaacagggtggcggttgataaccaggctgtgcctgaaattgtatacgtttctacctcaaaaacctcggcaaaggacaaattgaaaacggcaaaaaatctcgccgcactgattcatattgatactgaatttatgaaggatcgaaatatcattgattactggcttgcggcacatccgaagaaggcggaaaagcttatgaaggattcagaaaacagcctgaaatcccaagaagtgtacaaacgccagattgaacgcgttccgaagcaggagattgatgcgatcaaacaagataaaaaagagctgcaaattgcggcgatttatacgcgtttttcaagcggcaacgcctatcagccgcaagtcgtcaaatcaatggacccgaataagctgaacggaaacggaaacagcggttcattgcttgacgagcatgaaaacaacaagcaaaaaccaaaaagcgatctgacatatgaagaagtttccgtcgtatccgagcacctgaaagagctccccggcattgacgtgatcaatgactggacgcgaaaatatccatacgacaaaacgctgtactctctgttcggcggtgtgacgacaccggaacagggattgttgggcgaacggaaagattactatgtcacaagaggctactcactgaatgaccgggtgggaaaaagctacatcgaatatcagtatgaggactatttaaacgcgcataaagaaaaagtagagtatgtggaaaacagcaaaggtgaggtcgtcagccaaaagcccgtcgatgaaggcagcagaggctacgatctgcaactctcgctcgatatggaattacagtcgaaagtcgaaaaagtcattgaaaaagagctgagaagaagccgcgccgcaggcaactatatggttgacagaggatttgccgtcatgatggacccgaacaacggggatattctctcaatggcggggaaacgcatcgatctcgaaacaaataaaacacaggattttgcgatcggagcatttacgacccaatatgagatgggctcttctgttaaaggagcgactgttctcgcgggttaccaaagcggcctcccgcattataaaacgtttgtcgatgcaccgcttgtatttaaaggcaaaacgagaaaacaatcgtggacacaaatgggagccattactgagctgaccgcgctgcaaagaagttcaaacgtgtatatgtttcatgtggccatgcatatcgccggcattacctacaggccgtacggcacgctgcctgccggattagacgatattaaaaaaatgcgcaactactacgcccaattcggtttgggtgtgaagaccgggattgatcttccgcaggaatcagcgggcatgcagtcaaatccgcaaatggtcgggggattgctgcttgactttgcgatcggacagtttgatacgtatacgccgcttcaaatggctcaatatatttcagccatcgcaaacggcgggtatcgcgtccagccgcggatcgtcacaagcattcatgaaccggacagcaaaaataagattggaaaagcgattgaacagcgggatattaaaattttgaacaaagtaaataacagtccgagcgattttgaccaagttcataaaggaatgaaattggtcacaagctcacctcaaggaacggcttattcaacattccaaggttccggcgctgatgtttccggaaaaacgggaaccgcggagacgcactattacggcacgaacaaaaactggtgggggaagtacacgtataacctgacctttgtcggctattatccgtcagagcatccaagagtggcattcagcgtcgtcgttccgtctgttggaaatgataaagatcatgtaagcaaaaacattgctaagggagcaattgacgcttacaaagaacttgaaaagaaatacaataaaaaataacaaatgaaagggcggccgaacatctcgtgcgccctttctttcattcaggaaaattgacgttcacaataagaatagaaggagaatgctcattttttagcgaatcaatctagtggaatttctttttatatcagtccgtgtccagcctgcagtgcgagtataatgcaaaggagggattctgtggaacaggatactcagcatgtcaaacagtttcaatcgaaaaccgatcttcatgccgttttgacgtctaacgggcgtattatgtatatttccgcaaactgtaaatcgtacttcagttattctcaggaagagatgatcgggtcatttctcaaaacgttcctgcatgaagaagatcaatttttggttgaaagttacttctataatgagcatcatttgatgccttgcacctttcgtcttattaaaaaagatcataccatcgtatggcttgaagcgggtgtggaaattgtcacaccgcaaatggaggggacggatcgggaaatcatcctcaaaatcaaggtgcttgaggagaagacgccccgccggccttatatgtatgaacaaaagaagcaaaaggcagaacaacagtcggaagatgcggctggaaacggcgaattcgagcgtcttgttgaaatgctgccgaatcctttatatgtcagcatcaacggcacaatcgcctacgccaacaacgcgatgcttgccatgctgggagccgaaagcaaagacgaggtaatcggcaggcgctcctatgagtttattgaagaagagtatcacgacattgtgaaaaaccgaattgtgcggatgcaaaaaggaatggaagtcggaatgatcgaacagacgtggagaaggctcgacggcacgcccgttcatttagaagtgaaggcggcaccgacgacatataaaaatcagcgggcggaattgctgcttctgattgatatttcttcacggaaaaaattccaaacgattctgcaaaaaagcagagagcgttatcagctcctcattcagaattcaattgacacgatcgccgtgattcacaatgataagtgggtattcatgaatgaatcgggcatttcgctgtttgaggctgaaacatatgaagatttaatcgggaaaaacgtctatgatcagcttcatccctgtgatcatgacggcgtgaaacagcggatccaaaatattatcaaccgaaagaccgagtcagaaatcattaagcaatcgtggtttacctttaaaaaccggctgatctacacggaaatggtctgcattccgacgacgtttttcggagaaacggccgtgcaggtcattctgcgtgacatttctgagcggaagcagacggaggaattaatgctgaagtcggaaaagctgtctatcgcagggcagctggcggcggggatcgctcacgaaatccgcaatccgctgacggcgatcaaaggatttttacagctcatgaagccgacgatggaggaaaacgaacattactttgaaattgtgttttccgaactgagcagaatcgaattaattttaagtgagcttttaatgcttgccaaacctcagcaaaacgccgtgaaagagcgtgtaaacttaaagaaaattataagtgaagtgaccgctcttttagagacgcaggcgaatcttaaagggatttttatcaaaacggattacgaacatgacagcatgtatattaacggtgatcaaaatcagctgaaacaggtgtttatcaatctgattaaaaatgccgttgagtcgatgccggatgggggaacggttcacatcatcatgacagaagatgagtattccgttaatgtgacggtgaaagacgagggcgacgggataccggaaaacgtgctgaaacgaataggcgaaccgtttttgacaacgaaagaaaaaggaaccggcctggggctgatggtcacattcaaccttattaaaaaccaccagggagccatccaagtagacagcaaaccggacagaggcacggcctttcacattacattcccgaaacaataaaaaaaacaacggcgttatgccgttgtttaaatagtctgcatggattctctcgtttttaaaataaatgcttccagccggtccaagccttctctcaatgtatccagtgaatatgcgaatgacagcctcacatacccttcacccaactttgaaaacgagctgccgggcacaagagccacacctgcatcctctaaaagagccatactaaaatcaaacgatgacattccgaatgacttaatggaagggaagatataaaatgcgcctgacggctttacgacgtcaagccccattgaaacaagacggtcatatacatagtcaagccgctttttatactgttctctcataataagcgcatcatcaacaccgtttgtcaccgcttcaagagccgctttctgagagattgaagacgcgcatgtcacactgtattggtgaacttttaagatgtgcttggcaatttctttcggtgcgaaaatgaaaccgattctccagcccgtcatgctgtgtgattttgacaggccgttgatgacgatcgtctggtctctcaaataagacgcgatcgaataatgcggtctgtcataggttaattcgctgtaaatctcatcagacaggacaaaaacatttctgcccttcaggacggctgcgatgttttgcagctcttcctcagacaatgtcacaccggtcggatttgacggataaggaagaatgacgcattttgtttttggtgtcagcgattcttcaataagccgcgccgtcagcttaaatccgtgtgtcgtcgtatccacatgaaccggaacggcgcccgacatgcggatgatcggttcgtagcccggatatatcggtccggggagaataacttcatcgcctggagataaaatcgtccgcaaagacgcgtcaatcgcttggctcgctccggttgtgacaatgatttcagtttcagcctcataattcaaatcagcttttttcttcatataaagctgtacggcctgtctcagctcaaggccgcccgcgttcggagtatatgccgttgcgttctcgtcgattgcctttttggcagccgctttgacatggtgcggcgtgaagaaatccggctggccgatcgtaagcgaaatgacattatcgtgctgagctacaagatttgagaatttgcgaattcctgaaatttcaatttcttttacattcggattaagcaaatgttccataattcatcaccttatactatatattgagtttatcctattttaccactagctgagcatttgtcatctttttattgaactatcccgagtatatgtccgatatgtgaaaacataccttttttcagaaaaaaataagacaaccagctgaaatgattgtcttcattgtatcatgatctatctattgtgatatgtggcgaatgtcattaatacccgtattcaaagctgacgtcttcccgccataagatgtatggagcgggcttgtcgggacgctctttcgcctcttttttcatttgcaggtaagccgttttgctgatatcttctaacaccgtcatttgatcttggtcgaatatgactactgtacccatttattacacccttcttcctgaaaaatccttgactattttaccactcgatgtcaaaaagtcaatgggatatcagaaaaaagcatctttttataaagagttcatggccagttggcccgaatacattcactttttccgtttacagccgatatatacagtacaatactgaatgcggatagcgagggattgaattgtctttacaacaatacgatattttattggattcaggcacaaacgaattagaaatcgtcaaatttgaagtaggcgtcaatacatttggcataaatgtgatgaaagtccgggaaatcattcagccggtagatgtcacatctgtgcctcagtctcataaagacgtagaagggatgattaagctgagaggcgaaattcttcccgtcatcagtctgtattcctttttcggcgttgatgccgaaggagcaaaagacgataaatatatcgtaacggaattcaacaagcggaaaatcgtctttcacgtcggttccgtttcacaaatccacagggtgtcctgggaggcgattgaaaagccgacttccctgaaccagggcatggagcggcatttaacgggaatcatcaaactggaagacacgatgatctttctgcctgattatgaaaagatcatttacgatattgaatcggcatccggagttgagacttatcatgtccatcaggaaggatttgatgaaagacgggcgggtaaaaaactgatcatcgttgaagattcgccgcttctgatgcgtcttttgacggatgagctgactgaggcggggtacagtgaaatcgttacatttgaaaacggaaaagaagcgtatgattacgtcgtggaactgacggataacggagcaaacctgtcagatcatattgacatgattatcagtgacattgagatgccgaaaatggacgggcatcgtttgacgaagctccttaaggataacccgcaaagctctgatgtgccgattatgattttctcgtccctcattacggacgacctgcgccaccggggcgaagtagtcggagcggatgaacagatcagcaagcctgaaatcagcgagctcattaaaaaagtggatacgtacgtgattgaatagaaaaaagccgatgcatgacgcatcggcttttttgcggcggaattaaaaataactctcaccaagttttttaaatacgggtttatgataagcgggctgctgcctgttggcggcaagcggtttttcctttaagcccacatatttttgcaatacgtttttcgcttttgtcaaagacatttgtgctttaggattgcggtacgattgatttaacgtacctaaatgcggaagatgctggaagtcttcttttgttggaggcatgtgaaaatagtagtctccgatagagataagtacgtctgactgctgttggctaaacctgggattatttgaaaagtgaagccctatttttttccctttgccttctttcacaagcttttgtaatgcccgttttttcagcagataaaggtatttagggttgggggcggtttttgcatggcggttcacagtataaacagcttttgaaagattctcgatggttggctgcagctctttcgaataagcgtggtcgtccattatttctctcctttgcattgatcaagttcatatatagattatacttttttagcgttgaaatgcaaatattgattataaaaatacgcctttttctgatgaaaagggcgcatttttttcctttattagacaggtttcgcatgtttttcggaatcagcctttaatgattgctgcacatcgacctctgctgcctcggcgctgtatttcggaagagcgataaaatagaacacaaataccgctaaaatcacgattcccatgccgtaataaaggtaatcaatattggaaacgaatttcggaaataacagggcaaccagtccgagtgtaatcgattgggcaaacatcataaaaggatcctgccagccgctgacccggcccattattttcggatgaacgattttcggcatccagccgccgatggcgatattgacagggccgatgcacatgccgaggatgaaagccgccgcataataaatccacagcttatccgtatagccgaggacaaaaatgagcagtccggctgccaaaataggaatcgacatcaaatgatgcggtttgactttttttgcgatcattgttccgatcacacttcctgcaagcaggccgaagccgagtgcgacggtgaagatggaagtatgtgattcgtaatgatcaggcgcaagtccgtatttcatcgtaaacatcggcagtacggcaaagccgccgttgacaaaaccaaagataaaaaagccgaaaataagggaagcaagcaatttgtttttaacaatatatacgatcccttccttaaaatcagcgaccgagtctttcagaaacgaatctccccatttaaaagggccgttcggctgacgggcttctttcggaatgcggcaggcgcggatcagaaagcctgatacaataaagctgacaaaatcaaggataatggctccgtgaataccgatcgttttatacataaacgcgcccataccgacgccgaataccataaagatgctgaacaggatctggttaagtcccgccgctttcgcataatgctccttaggcagaatagcttgtacaaggctggcttccgccgggaaaaagaacttggtcacggcgcttctgatgaacaaaatacagaacacgagagggatgctcccggtgtataatgcggcaaataatacgatcgtcagtccggctctgatccaatcacaattctctgcgacctttttcctgtcaagccggtcagctgcgacaccgacaatcagaaatacgaaaactgtcggcagtgaatacatcagctcagccaaagttgtgtatgccggctggtttgaaaaatggtccagcaagtaaaaagcgaaagccatattacctacagtcgttcccatttgagaagcgagtgctgcgaaaaagagacggacaaaattgcgatttttaaatatatccataaacacgctccttaccctaaaggtcccactgtaatatattatcatcagctcgttccattaacaaataagatctttctatcttataatggtcacccttgttccattaggaacggtagcggcaagttcagtgacgtcctgattatacatccggatgcatccttttgataccgctttgccgatggaggaagggttatttgttccgtgaatgccgtaatgaattttagagaggctgagccaataagcgccgaacgggccgccgggcttgggctggcggttcacaatgtaaaattctccggtcggcgtggtcgtcaatatttttccgactgcgatggggtacgtacggatgagcctgccgaggcggtataactccagtttcttcgctccgatatacacgacaatggaatagggaatggtggatgggtcgggaagattcggtatgataatgtgctgtcccgcgtatatgaccgattggattgagggatttgcctgaaggagagcagcagtgcttattctgaagtcttgcgcaatgcttgagatggtttctccttgtttcacttgatatgtcagcagtttcgtcaccctcctttttgctcttttccatatacatattacggaggggatgtctgtgcatcgggataaaagtcttatttttgtacggttttcaatgtgaacagcgtgatttccggtctggctaaaaatcgatacggcagtcttgtcgtaccgagcccgcgattgacgtaaacggctgtgtcatgcagcgtatacatgccgtcggtatacgtttttccgtatggaggcgtaatgagagggccgaaaaacgggagctggacctggccgccgtgagtgtgtcccgacagctggaggtttacgggatatccgccgatcttgagagcggcatcaggctcgtggacgattaaaatggaaaacgcatcttcggaaaggcgggaaagggtgccttcataatcgggttttccgagcattacatcatccaaaaacgcgagttcaatccggcttccgtctgtcagctgcacctgacggcagccatttcgaagcacttgaaaatcagccgcttccatcagagccttgtacgtgttcgtaccgtagcctccgtggtcatggtttccgtaaacacaaagtttgccgaagggagcttccagattttgcagcacggccagtgcttgctggtgatcattaaataaatgcggcttatcaattaaatctcccgtaaagatgagcagatcgggtttcagctgattgatcttttccgctgctttattcaagtcaccggatgtaaacacatcactgagatgcgtatcgctgaattgaacgattttaaaattgtcaaagccgcgggggatcaggcggctggtgattgtatgacgggtgatctcaatcatgcgcggttcaatataccgggcatagccgtaacctccgcaagccgttgcgagagttgcacccaaaatgccgaatcctctttttaaaaatgttcttctcgtcattttctccatatgtaaaaccaacctttgtcagagttgttctattatatcatcagcctggctgaaaaatcccttctcagcatgtaatgacgcggaaagacatctatgataaaattatgaatgattattcattcaataaaaggggtgggtttgttatggataagaaagcggtaatcattacaggcggttcaagcggcatgggaaaagcaatggcgaaaaaacaggctgaattaggatggcacgtcatggtgacagggaggaaccatgaagcacttgaggaaacaaaaaaagaaattgagacctttgaggggcaggtcgcctgttttcaaatggatgtccgttctgattccgccgcttcagacatgattacagaagcgaaaaaagtctttggccggctcgatgcgctgattaacaatgcggccggcaattttatttgcccggcagagaagctgacgcccaatggatggaaagctgttattgagattgttttaaacggcacatttttctgcagccaagccgcggcaaggcattggatcgagcaggagcagaagggcgtcatcttaaatatggccgctacatacgcatggggagcgggagcgggtgtcgttcattccgctgcagccaaagcgggggtattgtcactgacaagaacgctggccgttgaatgggggagcaaatacggcatccgcacaaacgcgatagcccccggcccgattgaacggacaggcggtgcggagaagctgtttgaatcggaaaaagcggtgtcccgcactatgaacagtgtgccgctcggccgtctggggacaccggaggaaatcgccgctttggcagcgtttttgctatccgatgaagcatcctatataaacggggattgtatcacaatggacgggggcaatggctgaatccttacccgttttaatttacatgacatattttgcaaaacaagcgaacgttaaaggtgaccgttcgcttgttttatttttctattcaaaattatgatataatttttaaagattaagaggtgaataagtgaagaaattattaaaatggttcgttgtactatttgtaagcagtttcgttatcatctttaatatttggtactttatcatttgcgcttttactccggagtattatcaaaataccaatcttacatctgatgaaataatcagatttgaaaagctatatcatatagattttcctgatgaaacgaaatttattaaagccagggagtatttgagtgggctcggaggcgatacatcggctgtatgatatgtgtctctgccaaccaagctggcggaaacaattttatctgattatacgtatatgccaataaatcatactgatcatgccggttcaatgtatgaagttgacgtttccaagagtgctggcgggttaacaactcttacatttggcactttagataaaaaaggaactttctttcagttgaaacatgatgatgattggatatttaacagtactgattggagccattatttttggacagccgccggttatcatgctcttatatttatccttttatttgtgatggtgaaacaaatgaataacgtccttaattaaccggtctgaagagtgatcttaaaaagttttccccttttattttaaactgctgccatactgcctcctttttcccctaatctaaacatttgtggtgctgatataattgtgtataatcagacaaagatagagaagcaggtgataacatgttggacccacttgatatactgacgaatattgatgatgttattccgtattaccaagcgatttttaacgctgaggaacaaagagtcgtaggctacgaagtgcttggccgtattttggcagatgcggagattgagagcctcgggccgtttttcttagattccggcatcccggaagaatataagcttgaggtcgatgacagagtcatcaggcaggcgctggagcggtttaaagaagctgatcgcgatctgttgatttttatcaatcaggatgcgaatgtattgatgcttgaccacggcgagagctttcttgagcttttgaaagaatacgaagagcagggcattgaattgaaccgtattgtgcttgagatcaccgagcacaatttcgaaggcgacattgaacagctgtaccatatgcttgcctactatcgtacatacggcattaaaatcgcggtggacaatataggtaaggagagcagcaacctggacagaatcgcgctcctttcaccggaccttctgaaaatagatttgcaggcgctgaaagtatctcagccgtcaccttcgtatgagcatgtgctgtacagcatttcattgctggcgagaaaaatcggcgccgcgctgctgtatgaagatatagaagctgattttcagctccagtacgcatggagaaacggaggccgattttttcaaggttattatctgcaggcgccgagcggcgattttatagaccggagcctgttaaaagcacgcttgaaaacggagtttcagcaatttatcacgagagaaaaaaagaagctggagacagtatacgaacactctgagaatttttataagcgggtcaatcaggcagtttccgaactgaagaaaacccatcaggcggacgatgagtttattaaaaaactggcggaaaacctgaccgactgctgtttcagaatttatatgtgtgatgaagaaggctatcagctgacgggaaatgtgttcaagcagtccggcgaatggctttatcagcctgaatacgtggagaaaaactggagctggcgtccgtactttttagaaaacattatgaagatgcggaattcaagaaaaggctttttcagtgacctgtacagtgatattgagacgggtgagatgatcagaaccttttcatacccgatggatgacaatatgtatttatttatcgatctgccttactcttatttatatgaacaggacgggttactttaaagcggctgcagtatgccgcttttttttataaatgtgaaaaagttttaaaaaacgattgacaatgatagtgataatcattatcatttagttatagagagaagttactctctgttccccaacccctctatcagatcaagatccgaaaaagcttggcgctacccccgccaagtttttttatgctgtctgcgcataaaagggcttctccttacatacatctgacaatggcggctcaaaaagcgaaaaattatttttgaaaggtgtatgacattccgaaaaaagcttcaaactattcgaaaacacggttttcccgtttatttctttttgaaaatccagcgggaaaatgccatcccggtctactttatggtatgatgctctgtaggacttgtattataataaatacttgttgatttgaagttgttttttgaaaggagtctttttttagaatgtcacaattaatgggtatcatcacgcggctgcaaagtctgcaagaaacagcggaagcggctaacgagccgatgcagcgttattttgaagttaacggcgaaaaaatttgcagtgttaaatatttcgaaaaaaatcaaacgtttgaactgacggttttccaaaaaggtgaaaaacctaacacatatccgtttgataacattgacatgatttctattgaaatttttgagctccttcagtaatgtgatttgatttttcaggctgaccaagcttccggtcttccgcaagcggagctttattaaattatgcaaaggaacgtgcttgttcgtttggttgtagactctggaaagaggagtgtccgtacatggctgattcttttctgttttataatctttctgaggcacagatgacctttcaagacgtgacggagcggctgaaacgctttgtcaataaagacccccgttcagcatacgtgctgtctgtagggactgattcacaagtttaccgcgacttcacaaagtttattacggctatacacttgcaccgtacaggcaagggagcttggggctgtttgaaaaatcacgaccttgcaagaccgatacatagccttcgcgaaaaaatctcgctggaaaccgcgttcagccaggagatggctgcgcatatcctcgacggctgtcttatggaactgacagatttgctcttgccttttgcggatgaaggggcggatctttcatttgaagtgcatctggatatcggtcaaaaagggctgacaaaagaattgatacaagaaatgaccggccgcattacctcgatgggtattgaagcgaaaatcaagcccgattcctgcacagcattcagttatgccaatcgttacacaaaataatatttcatacagaatccgcaaaatgtcgaattatgcggttgacgatttttttctgtttacttattctagcggtagagctgaaagcaaatttcacattgctttcagaggtattcagttaaaaatagggggcctgattacgtatgagtcttatcagtgaacgatttacggaagaagaacagaaacttctgctgaatatcctgatcaatcaagaatatgccattgagcttttgaccagcgaaatcaacgatatagaagcagggtcaaaaagcgttgatgggaccacttataaaaaactcgtaacgctctatgaccgttttcggaacgaaaattaatcagcggcctataaattgatactcgattgcaaagagtatcttttttattgacggaaacttttcgacaaaaaatgataatgtttatattattgcaatatagggaatacatgctttgatgaaaaatgtaaaggggtcgaagtgacatgattagcttacaatcagatcagcttcttgatgcaacagtcggacaatttatgatcgaggcggataaagtggcgcacgttcaagtcggaaacaaccttgagcatgctctattagtgctgacgaaaaccggctataccgccattcccgtccttgacgcttcgtaccgtctgcacggtttgatcgggacaaatatgattatgaacagcattttcggacttgaacggatcgagtttgagaagctggatcaaattacggttgaggaagtcatgctgaaagacattccccgtctccacatcaatgatccgattatcaaagggttcagcatggtcattaacaacggctttgtctgcgttgaaaatgatgaaggcgtctttgaaggcattttcacgagaagagtcgtattaaagcagttgagcagtcatatcagatcattgaataagtaggctcgcacgatcagcctatttgttctttcgcatgccagaaaaagaaaacgcatacatacgagtggcgcttgcctcggcagcctttatttgattagaatggtagataaggaatacgaaaaggcattgaaaaggaggacgacatgcagcttcaagagcttcatatgctcgtagttttagctgaggaattaaacatgaggaaggctgccgaacggttattcgtgtcacagccggctctgtcccagcgattgcagaccattgaaaaaacctggggaacaaagatctttcttaggtctcaaaaaggacttacggtaacgccggcaggagaaaaaatcatacaatttgcaaatgacgtcacggatcggcaagaaagaatcagagaaaacattgatgaacttgagggtgagattcacggcacattaaagcttgccgtcgcctccattatcgggcagcactggcttccgaaagtgttaaaaacatatgtggaacgatatccgaatgcaaaggtctctctcattacaggctggagcagcgaaatgctgaaaagtctgtatgaagatcaggtacatatcggcattatccggggaaatccggaatggaaaggccggaaagattatttaatgaccgatcatttatatttggtcgatacggaaatttcctgtattgatgatattgcccataccgaccggccgtttattcaattcaaaagtgacagtacatattttcaggaaattcagcattggtggcatcaaaaattcaaaacctcgccgaaacagaccatccttgtcgatcagattgaaacgtgcaagcaaatggcgctgcacgggatcggttatgccattctgccgtcagtcaccttagaagaggaagataaagtaaataaaatgcccctgcttgatacaaaggaccatccgatcggccgtgacacatggctgctcggttatgagccggcatttgaattaaaacaggtgcaggcttttgtttctgtcattaaagatatgctgaaacaggaacgcccattttagaaagacagcaatcatgctgtcttttttttattttttattgacaatgaaaatcattatcatttaaagtgttatgtatgttaatgaaaatcattatcaattacgaggtgatcatatgcagaaagcattaatgatatacgcaagcatgtcggggaatacagaggatattgccggcattataaaagaaacactgagcgggcatcagatagcggttgactgtcttgatatggacgaagcagatgcggattctctcaaagcatatgattatgtttttgtcggcacatacacatgggggatggtgatcttccttacgaagcggaagatttttacgaagatattctgcacagccagctcaacggactgaaaacggcctgtttcggttcaggcgatcacgcctacccgaagttttgcgaagcggtcacgctgttttgcgatgcgtttgaacaggccggagccaatttatatccggaaacgctgaaaattgagctggcgcccgagacggctgaagatcaagaatgctgcaaagaatttgtccgcggttttcttgcatgggccgctcaccacggagaccggtgccatgtttcataaaggcgcgacggctgtcatggcatcagtatcttcaggattttttgtcgctgtgaaaggcgaaggtatttttcatttttcggcggaagaaggctggaaaagactattccgagtgaagagcaggattcatgtgctgacttatatagggccctacatattcgcggctggagaaaaaggcgccgtcctcagatcggccgatcaaggaaagacttggacggcctcccgatttccgaccagcgcctccgtatgggccgttgccgggcggaatgacggatttgtctgtgcgcacggcacatactgcatctacttatctgatgatttcggcgtcacttggcatgtggctaagcctttttcacaattaaaggagccgcctgtcatccgttcgctttgtttacacggtcagacggtttatatcggcacccggattcatatgaatcatggcggcatttgggcgtatgatctgacgacggaaggccgcatccggcgtataagccgcgaaaggcagcgcatgacggcttcaatgatgatgtatcagaatgactggctcattgcagcaaagggcgcggcaaagggagaacggggggagcttgctgtccgaaacgtgcggacgcatgaggagtttgccattacagccggggacaatgtacgggaaaaatcatttcttgacgtgtctgaggataacgggattatttatgtcacttcgtcacaggacgaaagcggattttcgcgtatttatcaagctgatctcgctgccggtgaattaaagtggtttgatacgatccgcggtcacggatggcgggtggccaaccgggaagaagattttttttgcgcgggcctttacgaaagtaagtttgtcagaccgtatgaggcggttcggctcgcacattagtttttatgcataaaggagagacgaagatggggaatgtattgcttgtttacgctacaatgtcaggaaacaccgaggcgatggcggatttaattgaaaaagggctgatcgaagcacaagcatccgtagacagatatgaagcgatggatattcatgccggactttttaatgattacgagtatattttattaggcacatatacgtggggagacggggatcttcctgatgaaatgctcgatattgctgaagatatggaaaaactggagtttacgggaaaaacatttgctttgttcggttccggagatacgtcctatgagtttttttgcggagcggttgacgaattggaaaaagtaatcacggcccgcggcggacgggtggtgctgccgccggtcaaaattgaaaacaaccctgagggcagtgaggaagaagagctccgggaattcggaagacagtttgccgcgctgtgcagccagccggcagaataaaggcttgttcctttttttcttgtctttgtatccttcctttgttacagtaatgaggtagaaaatcagaggaggacaatacatatgaaaatgatggatgcaaatgaaattatttcatttattcaaaatagtacaaaatcaacgcctgtaaaagtgtatgtaaaaggcgatctcgaaggaatcagctttggcgattccgctaaaacattcctgaatggccaatccggcgtcgtttttggcgagtgggctgaaattaaaagcgcaatcgaagaaaacaaagacaaaattgaggattacgtcattgagaatgaccgccgcaactctgcgatcccgatgcttgatttaaaagatgtgaaagcgagaatcgagccaggcgctattatccgcgaccaagtcgagatcggcgacaatgccgttatcatgatgggtgcatctattaatatcggttcagtcatcggcgaaggtacgatgattgatatgaacgttgttctcggaggacgcgccactgtcggcaaaaactgccacatcggagcgggttctgtattagcgggcgttattgagccgcctagcgctaagcctgttgtcgtagaagacgacgttgtgatcggcgcaaatgcggttgtgcttgaaggcgtaacaatcggtaaaggcgcggttgtcgccgccggagccattgttgtaaatgacgtcgagccatataccgttgtagcgggaacaccagcgaaaaaaatcaaagatatcgatgaaaaaacaaaaggcaaaacagaaatcaaacaggaattacgccagctgtaaggaatggtttgatagaatgggcgtggatgataaaatccacgccttattcttatctcaaggaggaatacatatggaaaaagagcggctcattgccatccgaagagatctgcaccgcattccggagatcggctttcaggaatataaaacccagcagtacctgctgaatcttttaaaccaatatccggaagaaagaattgaaatcgaaacttggagaaccggcatctttgtcaaaatcaagggcacggctccggaaaaaatgctcgcctacagagcggatatagacgctctgtcgattgaagagcagacggggcttccgtttgcatctgagcaccccggttttatgcacgcatgcggacacgatatgcacatgaccatcgcgctcggcattattgatcattttgtccatcaccccgtcaaacatgatctgctctttttattccagccggctgaagaaggaccgggcggagcggcaccgatgcttgaaagcgatgtgctgaaaaaatggacgccggatttaatcaccgccctacatatagcaccagagctgccggtcggcaccatttccaccaaaagcggattgctgtttgccaatacgagcgagctcgtcatcgatcttgaggggaaaggcggacatgcggcatatccgcatacagcagatgacatggtcgttgccgcgagcacgcttgtcacgcagctgcaaacggtcatatccagaaatacggatccgcttgacagcgctgtgataactgtcggaacgattaccgggggcacggcgcaaaatatcatcgcagagcatgctcatctggagggaaccatccggacgctttccgaggaatcaatgcgtatggtgaaaaagcggattgaagagcttgtcaaaggaattgaaatcggcttccgatgcaaaggaaaagtcacgtatccgtccgtttatcatcaagtttataatacaagcggcctgaccgaagaatttatgcaatttgtcagcgatcatcagcttgctgacgtgaaaacggcgaaagaagcgatgaccggagaagatttcggatatatgctgaaaaaatatcccggctttatgttctggctgggggccgattcatcccacgggcttcatcacgccaagctgaacccggatgaagatgcgatggaaaccgcggtaaatgtcatggtcggatatttttcgaagtatgccaattaaatccgaaaagaagaataatctaacaaaaattgagcattctacataacggaggtgttcaatatgacgaaaaaaattggaattgaacaatctttatcggatgtagaacaggcgttaaaacaaaaaggatatgacgtagtgatgatgaagactcctgaggatgcgaagaattgtgactgctgtgtcgtaaccggacttgacagcaatgtccaaggcattgccgatacgtcaactcaggctcccgtcattacggcttccggaatgaccgccgacgaaatctgcagcgaagtggaaaaaaaatttcattaaaaagaaaaaaccgaagcttacgcttcggtttttctattcggcggaagcggcgtttttaaaacggtcgagcgcgattttcatttctctccgcagtacgcgttcaacccgccattgctccatattttctgttttggcaatgattctgatcaccatttctgacgtgcttaaatcctgaaccccgatgacgtccggcccttccttaatctgcgggagctcagcggctgctttgtcacacgcggtttgcaggatttgaatggtttcatcaagatttttttcaagcggcactttaatatcgacaagcgcctgcatcgttccgcgggaatggttgctcacattcgtaatgccccggttggggagatagtgaagcgtgccgtcaaagctacggatttgcgtcgtacggagaccgacctgctcgacaatgccgctgtagccggcaaccgtaatataatcaccgacgtcgatctgtttttccaaaaggataaaaaatccggtgacgatgtcactgacaagcccctgagccccgaagccgacggcgagaccgaccacgccggcgccggcaatgagagcgctcggattgtagtgaaataaatccaaaatcattacgataaaaacgaaaatcaggatgtatccatacacattaagcgcgaggcttcgcaaagtataagcgcggcctgtggagaggttgttttgttgctcgaatttctgaaacagatgcttgatcagcttttttcctgccgtccggaaaataaaatacgctaaaataatgagagccagctttatgatgaaaatcccggcagatgtgagaagcccggcccaatcaaagtgttttaaatcaatcatagtgatgtcttcctttcaagtctattgaggaaaaagctaaaagtgatatacccgttttttaaataagataaaccttttcatagaaaccagttattacatttatgatttgttcatattgcccggtttcaatatcttcatttttgtgaagatatgaactaaggaatcgccacactcattttaacatggtgattcagccaaatcatttcctttggagggaaaacaggagaacgttgccaggcggactgaaagccccggcaaaaaacttttttcataaggagggaaataagatgaaattacatcagcaaatgcctgaattaacaggcgctaaagcatggattaacagagaagttacgaaggaacagctggtcggcggaaagccggcactgattcacttctggtccgccagctgccgcatgtgtaaagaagcgatgcctgaggtgaacgggtttcgtgataaatataaagatcagctgaatgtggtggccgtccacatgccccgttccgaagacgatcttgatcttgagaaaatcaagaaaacagcggctgaacacgatatctctcagccgatttacgttgacagcgatcatacgctggctgacgcatttgaaaatgaatatgtgccggcttattacgtttttgataaaagcggacagctccgccattttcaagcgggagagagcgggatgaaaatgcttgaaaaacgcatcagccgggtactttcagaaacggagcaggcttctgagtaatcgggacaatctccgccggactattgtctcggttctgcaaaccctttgccgttaggtaacagggtttttttgtggctattggataaaaaattccaatatggcatgtatggcttaaaaaataagagaaacagccgtaaacacgctgtaccgcttgttttatccatatcattaacttttacatattatagtcgaaaattgtagatatcacgctaattttcattaaacaagtaatttcaagttatattttgaaatggttcaataaattggaactttgtccagaatcccctatatgataagggatttttgtatataaagtaccattttcagaaaataagcaatttttcatagagtaaataaaatagtaaaatgataaaataatagttgataaaattacttttgtaatctaatatcttaataaaagcgtttaaatttttgacagggggttttacacatgtttaatgaaagagaagcgctgcgcttacgtttagaacaattgaacgaagcagaggtaaaagtcattcgtgaatatcaaatagaacgtgataaaatatatgcaaaactgagagaattagacaatacgggcagcctgtccgatacaaaaaaagagtttcgtccggagaaaaaaagtgactctctcccggtgcttgcagagcttgcagcacaggaaatgagaagctatcaaaagccgcagacacagccgcaatcctcccagccgcagatgcagtctattacgtctcttcccgccggcattccagacggttctacaagaagaagaagagggacggcgagaccgggatcaaaagcggcaaaactgcgcgaagcagcgattaaaacattgaaacgccacaatgcagcgatcaaaagttccgaactgcaaaaggaaattgaaaaggaaagcggccttgaaattcctaatatgacaacatttatgcaaagcttaattaaaatgtatccggaagtgaaaaaaccatatcgcggccaatatattcttgagggagaaatttctcaggaaacagcagaaacggcaaatgatacggctgctgaataaaacagtaaaaactgcttgcgttactcaagcagtttttttgcgttttcccgtttattctgcggaagtgacgcatcttttccaggctttttttcaagcttgacaacatatttttggaaaggcttttcgccgtcagctcgttctttcaacgcatccagtttttcatcaaacgactgatcgcgggactctgattctacaaattgtttttgaagggagatgacttgttcggtaacggctgtaagcaagtcttctgcctgaacagtctctttggaaacggaagggatttccagagtttgttccgccggttccgccgtgcggctgtcaatatcagcaaaatggccggcaatccaagcatcgctttcgtcaagctgccgtttatatgaaagaatggtttcttgaaataacttttctttcgttttttctatttctacaagccgttcttttgtttctagtattcgatctctcatatgattaatttctattttaatatgtttgagctggtattctttttctatcatttgtgtttggagccgggtattttcgtctgcagcggcatgataacgctgtttcatatcttcgtgagaagtccgttcggtttgaacggcggtctcaagtgagcggatgcgggtatgtaagtttttattttcttcttcaaattttacatttgtaagatgcagccgatgtttttcttccatctcatttttccgccgaaacgtttcctgctgaagcagttcttgcagaatgacgattttatcgagcagcccggccctgatttcatgcaaagaacgttccgtgtcactagtctgtttgtgtttttgcgccatggcttccaattcgtcagaaagcttgtgaagccgctctttaatattggcgttttcctcctgaagcttattgtttttttgatggaagtagcttgcttcaaattccgaaattatttttctgcatctggaaagttcggatttcaagtaaaggttctcttgagaagtgtcgtggaaaaacggacctgatattttcataagaaccatctccctcttgatgttaacactacaatatgggaaaggaacaacggctattcctcttaattaaacagacaagcaccgtaatattgtatttcggctgaggcgtttgctatgcttttatatagaatgggagagcgatgacatgaaacgggtgaatgtaatattagcgggggagcttcccgaagattcggagaaccgaaagcttttgcaaagtggaagggcggcatgttttatgaacaggcgaaaaaagccttcggcggcggagaaacggtaattatcagccgccctgagcatataaaaaagttcttatcaaacagggagcggcatgtttttgccgatgagccgcggtttcggggaatgggcccgcttgccggcatatatacggcaatgaaacaaacggaaggcgaaacatatacggtcatatcctgtgacacgccgctcgtgacaagaaaaacgatggctgcgcttgaaatgaagctgacgggaaatctggacgctgtcataccggtttgtgaaaacagagagcagcccctcttggcggtttaccataaacgggtgcaggatgtgctttttgatcagctgacacaaaacaaactgaaaatgacagacacgctgaaacggctgtctgtctgttatgtgcaggctgaagacatcggcgccgggccggaggagttcgctaatatcaacacacgggacgattacaccagacttttggcgcatgtcgagtcttcaaatcaggactgatcggtaagaaacatggtatgatggaaataaaaatgcaaggggacaacacagatggaagagcgctattcacggcagacaagatttaagccgataggggaaaaagggcagcaggcgctggctgacagcagtgtcctgattgtcggagccggagccctcggaacagccgcggcagagggccttgcaagagccggagcgggccgtatggcgattattgaccgggattatgtggaatggagcaatttacaaagacagcagctgtatacagaagaagacgcgagacagcgcctgccgaaagcaatggcggccaaggcgcgtcttttagcggtaaacagtaatatacatatcgatgcttacgcggcggaaggtacggcggaaacgctcgaaccgctgatcgaacaagcggattgcattgtggatgcgacagataattttgaaacgagaatggtcatcaatgatctggcgctgaaaacgaaaacaccttggatttacggtgcctgtgtcagcagtcagggaatgtgcatgacgattattccgggggttacgccgtgtttatcctgcctgtttgagcaaatgcccgtgggcggagcgacatgtgatacagcaggcatcatacctccggcggttcatatcgtctccgcctatcagcaggctgaggcgctgaaattgctgacaggaaatcatgcggcggtaaatcggcgctttttcacgtttgacgtgtggaataacaccaatatgagcataaatgtggatcagatcaaacgggatcattgcccttcctgcggcgcggagcccgtatatccgtatctgcagcctgaaaacaggccgaaagcaagcgtgctgtgcggaagagacaccgttcaaatcagatcggaagccttaaagaggctggataaagaagagcttgtcaaacgtctgaagcagatcggtaaagtggaagcaaatgaatttttgctgcacatggcgtacgagcgcttcagaatcgttatttttcaggacggacgggctctgattcacggtacaaacgatataaaagaagcgaattcagttctggccagagtgatcggactgtaggaaggggatgtattgctatgcttgaaaaaagaacgccgattcaggtggacgaagcagtccgccgggtgagccggtataaaaaaaagggggataccgaatgggtggcgcttgaggacagtctccaccgctatttggcggaggatgttaaggcggatcatgatgtgccggcttttaaccgttctccgtatgacgggtttgccatcagggcgagcgattcaaaaacggcttcccgtgacaatgccgtcacctttgaagtcattgaccatatcggagccggcgccgtgtcagaaaaagaactcgggccttatgaagcggtccgcattatgacgggggcgcagattcccaaaggcgcggatgctgtagtgatgcttgagctgacaaaaacgttttctgaaaacggcacgaattacatgtcagtgaaacgcccttttcatgcgggcgataatatttcatatcaaggagaagatgcgaaaaaaggcagctcgctattaaaaaagggacgaaaatcacgccgggcgtaaccgctcttttagcaaccttcggctatgcttccgttcccgtggtcagaaagccggttgtcggcattatcgcaacgggaaccgagcttcttcatgtcagcgatccgcttgagccggggaaaatccgcaacagcaacgctgccatggtgtatgcccaggtcattgaagcgggtgcagtaccgctgaacttagggaaaatttccgatgattttgatgacagctatgctgcggtgaaggaagctatgaaaaaagttgattttctgatcacgaccggcggcgtgtcagtcggcgattttgattttcttccggacatttataataagctcggagcggaagttctttttaacaaagtggcaatgcgcccggggagcgtgacaactgtcgcccgggccgatgacatgctgctgttcggcctttcaggcaatccgtccgcatgttatgtcggattcaccctgtttgtcaaaccgatgattcagacatggcttctgaatgaaaaacctcattccggatgggcggaagccgtgttaacaaacgactttccgaagccgaatccgtttacgagatttgtgagggcatttgtttatcataaggacggaaaaatgatggcgtcaccggtcggtctcgacaaatcaagctcagtcacatctcttgccgaagcaaacgcgtttatccttctgccgggaggaacgagggggtatgaagcgggccggacggttcacgcgctcctcatccgtgatgagaatggaagtgaatggccgtggtcaattctttcccgatcgtccagatcgtaggttttcaaaacagcggtaaaacaacgtttattgaacgtgtgctgaaagctgcgccgaaagagtgcgatattggatgtttaaaacatcacggacatggcggagaaccggaacctttttctgacggaaaagactcggagcgtttttcaaaagccggagccgcggttacggcagtagaaggggacggcgtcctgcagcttacggcgcgaaaaaaatgggatctggcgggtttgatcagtctgtatgaatgtctgggaattgacggtcttctcatagagggatttaaacatgcgccgcatccgaaaatcattatgatcaaaaacagcgaagattggcaaaagctgaagcatttggagcgcgtgatcgcggttgtcagcagaaatacggagcatatgccggcagatgcgggcaagcccgtattccatgcggacgatcctgctgccattatgtttgtgctttcgcagctgaaaggggaaactgcttaaatggaacgttttcaaattacaagggaacctatcattgcggaaaatatcgtaaaaaaagttgaaaagcgtgaagccggggccatcacaacgtttatcggcacggtcagagagtggactgcaggacggcggacggtgcgtctcgaatatgaagcgtatgaaccgatggctgttcaaatgctttctcaaatcggcagtgaaatcagcgcgaaatgggaaggagccgaagctgcaatcactcaccgtgtcggcgtccttgatatcggtgaagcagcggtcgtaatcgctgtgtcttctccgcacagaaaggcggcatatgaggcgaatgaatatgcaattgaacggataaaacagattgtgccgatatggaaaaaagaaatctgggaagacggggaagaatggataggcgatcagctggaaacaacgccctatccgaacggaaaaccggatttggataaaggggaatcgcgatgattaaagtattattatttgccgggcttgcggagcaggcgggaacaccggtcattgaacttgacgaaaaagagacggcagcgtctgctgtaaaaacgctgttaaaggaacggtacggccttcagacgattgacaatgccatgatcgcaatcaatgaaacatatgtaaaagacaacagcaccgtaacagaaggtgataccattgcctttatccctcctgtaagcggagggtgaaaaaagagccggatgtgcatcattgccatccggcttttttgtttataggcgctgaatttcagagaatatctaaatgggatttaaagggttttgcaattgaggcggttttcactgcatgaataggctgataacagtgcctttacaaggttttgagttacccgtcataccggtctgacgatgcttttttttacataattatggaacgtaaagctgagaatttgtgttacaatttagcataaatacgcaaacggcaaaaaaattgaaacttctctcagcctaaagcgtacgtataaacagaataatacataggaggcatcagctatatggaaccaaacctggaaaaaagcaatgcggcagtcacggaaaagccgtcaattttcggcgtcattacaagtcctgttgtgcagtttaaaagattaaaagaaaagccggtcatcggcatacctctcctgattgtcatcattctcatcgcggccggcagtattttgcgcggactggggatgaattatgaagaagtgctgaacagctcatctcttgacggtttgacggatgatcagattgaaatgaccaaaaccttcgctaaattcggcacgatgttcggaggaatcttcgggggcattatcgctctgtttatcgttccgctcatttactggctgtgcgtcaaaatgtcaggcggcgtgacaacttacaaaaaaatgctctcactcagcctgtttacggcgtttattaccaatatcggcttagttattaacggtcttgtcacttattttaccggtgcgggctcattgtacgccgttacatctttggcgagtgtcataccggccggagacggcgtcgcggtctttttaagcgcgttcgacattttcagcatctggagctatattctgctggctttgggacttcgctatacaggcggcatttcgaaaaaagcggcctggacttccgcgattgtcctgtttgttattatgcttttggtttcggcagtcggaggactgttaagttcagtgacagcaggtgtataacatgaaaaaaatttggatcggaatcggcatcgccgtaattgttgcagtatttatcggtatcaatatttataagtctgccgctcccgcgggcggcagcgccggaaaaaaaatcgaaaccggaaccatggaaaacagagaaatctcatctacggttatggttccgggaacacttaaattttctaaagaacagtatgttttttatgaagcagataaaggaactcttgataaagtgaaagtaaaagaaggcgacaaagtaaaaaaagggtcgtcgttagtcacgtatacaaatgagcagctcaaccttgataaagaacaaaatgagttgacagaacaatcaaaacggatgcaaatcgaacaagttgaagaaaaactcagagcattaaacagcaaggaacaagatctggcaaaacaagtgggagaagcggaagccaaaaaacaaattgaatccgaacggactgatctgcagcttcagcaaaaaacggcggaaatcgaattaaagcaatctgatttgcaaaagcagtctcttgaaaatcaagtgtcgaatctcaatgttaagagtgagatggacgggacggttatctcggtaaatcaagaagcggcttctaaaaaatcggatattcaagaaccggttatacatataggagacccggaacacctggtcgttgccggcaatttgtccgaatacgacacgctgaaagtgaaaaagggccaaagcgttacaatcacctcagacgccatccccggtaaaacgtggaaagggagagtggcggctgtcggcctcgttccggatcaaaagtcaagcgctgcttcgggggaaagcacggaacaagccgtccagtatccgtttcaggttaagctgatcggaaaccttccggaaggcaagccgggatttaaattaattatgaacattgaaaccgacaaacggaaagccgacacgctgccgtcctccgcagtcaaaaaagacggagatgagcactgggtctttacggtaaaagacgggaaggccaaacgcgtgaaagttaaagtcggcgataccgcaaatcagcttacggagataaaagaggggctttcaaaggatgataaagtcattctgaatccggctgacggtttgactgacggaacggatgtgaaagcatagatgattcagctttcaaaggtgaaaaaaagctatcagatcggcaaggagacgtttgatgttctccgttcaatcgacctgacgattgaagaaggagaatatgtgtcaattatgggaccctcgggatcgggaaaatctacgatcatgaatatcatcggctgtctggacagaccgacgtccggcaattacagtcttgcgggcgaagatgtttcttcatgcaccgaaaaagagcttgcggcggtccggaacaaatcaatcggttttgtctttcagcagtttcagctgctgccgcgattgaatgcaagaaaaaatgtcgaacttcccatgatctacgccggtatcggcaaaaaagagcgtgaggaacgggctgagcacgcgctggaaaaagtcggtttggcggatcggatgcgtcacatgccgaatgagctgtccggcggccagaagcagcgtgtcgcgattgcaagagccatcgtgaacgaaccgaagctcattttagctgatgaaccgaccggcgcgctggatacgaaaacaagcatttccattatggagcagttcacagagcttaatgcagagggcgtgaccgtggttcttgtcactcatgagcctgaagtggcggactgtacaaacagagtgattttcgtccgtgacggcatgatcgtttcccgcgattctgagcagaggagagtgggggaatgagcctgtcagaaaatctccggatggccctcagttccgtaagagctcacaagctgagatcgattctgacaatgctcggaatcattatcggcgtcggttcagtaatcgttgttgtggctgtcggccagggcggagagcaaatgctgaagcaatccatcagcgggccgggcaatacgattgaattgttttacatgcccagtgatgaagaattaacagccaatccgaacgccttacagcaagcgagttttacagaagaagatattaatggattaaaaggagtggacggcgtaaagcaggttgtcgcttccgcggtaaaatccatgacggcccgttaccatgaagaagacacggatattacgctgaacggcattaacagcggctacttggacgtaaaaaagctggacgttcaagatggacggacgtttacggacaatgattttctttccgggaaaagagcgggaatcatctcgaaaaaaatggctgaaaagctgttcgggaaaacgtctccgctcgggaaaatcgtctgggccggcggacagcccgtagaagtaatcggcgtactgaaagaagagagcggctttttatcgttaggactcagtgaaatgtatgtgccgttcaacatgctgaaaacgtctttcggtactaacgactacagcaacgtttccgttcagacggagtccgctgatcaaatcaaaacaacaggaaaagaagcggcccgtctcttaaatgacaatcacggtacaaaagaggcctatcaagtcatgaatatggaagaaatcgcggcgggaatcggtcaggtcacgaccgttatgacgacgatcatcggttcgatcgccggtatttctctcgttgtcggcgggatcggggtcatgaatattatgctcgtatcagtgacggaacggacaagagaaatcggcatccgcaaatcgctcggtgccacgagaggacagattctgacacaattcttaattgaatctgttgtgcttactttaatcggcggcttaatcggaatcggtctcggctacgggggagcaacactcgtttcccttatcgcaggctggccgtcgctcgtttcctggcaggtggtttgtatcggcgtgctgttcagtatgctgattggcgtcatcttcggcatgctgcccgccaacaaagcatcacgcttagatccgattgaagcgttacggtatgaataaccggcgccccatgcagtctgcatggggttttttgtgttttaatgattgaatgaatataatagacttttttcatttatgataaaaagaaaatgtcatacaattgtcccctttttgtcgaatttacagtttacaaaccctatgtacatacgttaatatgaacaaatgtgaaagattttgatagttattgaatgaatttgagtgattttagttgcttgaagtaaaaaaagcgtttacaattatcttgcagccgaaatgaatacgttttcaaaggaggcggaatatgctcactcctgaaaggtatcagctgattatggatcagattgaaaagcgagatgtggtgaagattcaagagctgataagcatgacaaacgcttctgaatcaacgatcagaagagatttatcaacacttgaagagcgcggatttttaaagcgcgttcacggcggggcgtctaaactttccaacagcaggcaagaacccgatatgcttgaaaaatcctccaaaaaccttcaggataaactgaagatcgctgaagaagcggcatctttattagaagaaggtgactgtatttaccttgatgcgggaacaactacattgcacatgattgattttatagatcatacaaaggacattgtggttgtcacaaacggggttatgcatatcgatgctttaataaggaaggggattcctttttatcttctcggaggatatgtgaagcatagaacaggtgcgatgatcggcggcgcctcattaacggcggtcagccagtaccgttttgacaaaagctttctcggggtgaacggcgtgcacattgaagccggctttacaacacccgatccggatgaggctcttctgaagacaaaggctgtgagacaggcgaaaaatgcgtatgttttagccgatccttctaaattcggcgagatttctttcgcagcgttcgccgccttgggcgatgcagctatcattaccactgaagctgaagaacttgcattcgatgattaccaagaaaaaactgtcgtaaaggtagtgaaaccatgatttacactgtaactctcaatccgtctgttgactatatcgttcacgttgaagattttgccgtaggcggtttaaaccgttccagctatgacacgaagtatcccggcggaaaaggcatcaacgtttcgagattactgaaaagacaccatgtgccgtcaaaagcattggggtttgtcggcggatttaccggaaattatatcacgtcatttttgcagcaggaaggtctggaaacggctttttctgaggtggatgaagacacgcgtataaatgtaaaactgaaaacgggcgatgaaacggaaattaacggacagggcccgacgatttcagacgaagtgttcaatgcctttttagaacagttctccgctctggaagagggagacatcgtcgttttagcgggaagcatcccttcttccctgccgcataacacgtatgaaaaaattgctgaggcatgcagaaagcagaatgcccgggtagtggtggacatctccggtgaagcgctgatgaaagcgacagaaatgaaaccgtttttgatgaagccgaatcatcatgagcttggggaaatgttcaatacggtcattgattcagccgaagctgccgttccttacggtaaaaaattaattgaacaaggcgctgaacacgcgattgtttcgatggctggcgacggtgcgcttttatttacgaaagaggcggttttcctcgccaatgttcctaaaggaaagcttgtcaattcggtaggcgcaggtgattccgtcgtcgcgggattccttgcgggaatttcaaaacagctgcctttggaagatgcgttccgtttaggagttgcttccggaagcgcgacggcattttctgaagaactcggaactgaagagtttgtacagcagcttcttcctgaagttaaagtcacacgtctatagaggaggaaagaaaagtgaagataactgagctgttaacaagagatacaattcatctcaatatagaaagcaaagagaaagaaaacgttatcgatgaaatggtgacagtgcttgacaaagccggcagattaaatgacagagaggcttacaaagcagccattttaaatcgtgaaagccaaagctcgacgggaatcggcgaaggtattgccattcctcacgcgaagacggcgagcgtcattaacccggccattgcattcggccgttcaaaagatggtgtggattatgaatcattagacggtcagccggcacacttggtctttatgattgcggcaaccgaaggagcgaacaatacgcaccttgaggcattatcaagactttcaacgcttcttatgcgtgaggaaatccgcaaacagcttcttgaagctgaatcagaagatgcgatcattgacatcatcaatcagcatgacaaagatgacgatgaggaagaagaagagcaggaagaacaggcagcgccgtcaggaaaagggaaaatccttgcggttacggcatgcccgacaggtatcgctcatacgttcatggcagctgacgcactgaaagaaaaagcgaaagagctcggcgttgacattaaagtcgagacaaacggctcaagcggtattaaacataagctgacggctcaagaaattgaagacgcgcctgcgattatcgtggcggctgataaacaggttgaaatggagcgctttaaaggcaaacatgttcttcaagtgcctgtgacggccggtatcagacgtccacaggaactgattgaaaaagccgttaaccaagatgcgccgatttacgagggcagcggcggaggatcttccgcttcaaatgaagacggtccgaaacagaaatcaggcacaagcatcggaagtactttctataaacacttaatgagcggtgtcagcaacatgctgccatttgtcgtcggcggcggaattctcgttgcgatttcattcttctggggaattcattcagctgatccgaaagacccgacatacaacacgtttgctgcagcgctgaactttatcggtgacggtaatgcgttaaagctgattgttgcagtacttgccggattcatcgcaatgagtattgcggaccgtccgggatttgcgccgggtatggtcggcggatttatggctacgcaggcgaatgccggattcttgggcggactgattgcgggattcttagccggttatgtcgtagtccttttgaaaaagctgtttgtctttattcctcagactcttgacggattaaaacctgtattgatttatccgctgctcggtatttttatcaccggtgtcctgatgcagtttgtcattaacacacctgtagcagcgtttatgaatttcttaacaaattggcttgaaagccttggaactggaaaccttgtcttaatgggtattattttaggcggtatgatggctatcgacatgggcggcccgctcaataaagcggcgttcactttcggtatcgcgatgatcgatgccggaaactatgcgccgcatgcggccatcatggcgggcggaatggctccgccgcttggaatcgcactggcgacaacattctttaaacacaaattctctaaacgtgaccgtgaagccggtattacgtgctacttcatgggagcagctttcgttacagaaggcgccatcccgtttgcagcggctgatccgcttcgcgtcatccctgcagccgttgtcggttctgcggtagcgggcggactgacagagtttttccgggtaacgcttcctgcaccgcacggagggatattcgttgcattcattacgaaccatccgctgctttacttaatgagcatcgtgatcggagcgattgtaacggcggttatcttgggaatcatcaaaaaaccggtagtagagaaataagcgaaaagcgtcctttacgggcgcttttttcaatcatatacgcatagaagcgttatgtattttgtgatgagttgtgataaagtaaagatggtacatgaaccgaaacagtgatcgtctaggaggaaccacgttgactgaagaacaaaaacctacttctgaaaaatcggtaaaaagaaaatccaacacgtattgggaatggggaaaggccatcattatagcggttgcacttgcgctgttaatccgccatttcctgtttgaaccgtacttagtggaaggatcatcaatgtacccgacattacatgacggtgaaagactgtttgtcaacaaaagcgtcaattatatcggagaaatcgagcggggggacatcgtcattattaacggcgatacatcgaaagtccattatgtaaagcggctcatcggaaaaccgggagaaacggtggaaatgaaaaatgacacgctttacataaacggcaaaaaaatcgcagaaccgtacctcgcgagcaataaaaaagaagcgaaaaaactgggagtcaacctgacgggagatttcggccccgtaaaggttccgaaaggcaaatactttgtcatgggcgacaatcggctgaactcaatggacagccggaacggcctcggcttaattgccgaaaaccggatcgtcggcacctcgaagtttgtgttcttcccgtttcatgatatgcgtcagacaaaataaaaacgccgcgctgcccgattcggacagcaggcgtttttatttggcaaacgaggccgcgacggcgatgaacaataccgtggccagcactgatccgacaatggccagaacgctgaaaaaaagattcacctgcttcttctctttgccgcgtctttcaagcatccgtttggaaaagagatgcgaaaacgtataaatgagggcgattccgacgtacaagccgatgtcacgtgccgtaaagcctgtgacggccagaaaaaccccggtgaagaaaatcataagacagtattctgtgagtgttaaaagcttcaacttgttcctccgtgatgaatatgtatatatatctattgtatcacagcgctccgggtttgacgcctgcatcttttcaaacccgtatattcgcagggaaacatttctcttcccctttattcatggtatacttttaatgatgatagacacgatggaggattctaaatgattgctgtaaataatgtgagcttgcgttttgcggatcgcaagttatttgaagatgtcaatattaaatttacgccgggcaactgctacggattaataggcgcaaacggtgccggaaaatcaacatttttgaaaattttatccggtgagctggagcctcagaccggcgatgtccatatgagtccgggcgaacgtcttgccattctgaagcagaaccactttgaatatgaagactgcgaagtgctgaaagtcgtcattatgggacataaacgtttatacgaagtcatgcaggaaaaagacgcgatttatatgaagcctgatttttcagatgaagacggcatccgcgccgctgagcttgaaggagagtttgcggaattaaacggatgggaagctgaaagtgaagccgctattttgttaaaggggctgggcatctctgaagacctgcatacgaagaaaatggccgacttaggcggttcagaaaaggtgaaagtgcttttggcacaggcgctgttcggcaagccggacgttctgctgcttgatgaaccgaccaaccacttggatctgaaagcgattcagtggctggaagagtttttaatcaactttgagaacacagttatcgtcgtatcccatgaccgtcactttttaaataaagtgtgcacgcacatcgccgatcttgattttaataaaattcaagtgtacgtcggcaactatgatttctggtatgaatcaagccagcttgctttaaagctttctcaggaagccaacaagaaaaaagaagagcagattaaacagcttcaggagttcgtggccagattcagcgccaacgcctctaaatcaaagcaggcgacatcaagaaagaaactccttgataaaatcacgcttgatgatatcaaaccgtcatcacgccgttatccttatgtcaatttcacgccggaacgcgagatcggaaatgacgtgctgcgggttgaaggcttaacaaaaacgattgacggggttaaggtgcttgataacgtcagctttattatgaacagagaagacaaaatcgcatttacgggccgcaacgaacttgccgttacgacattgtttaaaatcatttccggggaaatggaagcagacagcggcacatttaaatggggcgtgaccacttctcaggcgtacttccctaaagacaacagcgaatattttgacggcagcgatgcgaaccttgtcgactggctccgccaatactcgccgcatgaccaaagcgaaagctttctgcgcggtttcttaggacgcatgctgttctcaggagaagaagtcaacaaaaaatcaaacgtcctttccggaggagaaaaagtacgctgcatgctttcaaaagcgatgctttccggcgcgaatatcttaattctggatgaaccgacaaaccacttagatttggaatccattacagcgcttaacaacggcttaatcagctttaaaggcgctatgctgttttcatctcatgaccatcagtttgtacagacaattgccaatcgcatcattgaattaacgcctaaaggcattgttgacaaacaaatgtcttatgacgaatttcttgaaaacgcggatgtgcagaaaaagcttgaagagctatacgcgtaataaagaagcaggggagactctgcttttttatttatgaaaaaagttttcaatcttctgacttcccattacaataaaggaatacataaattgaaaagagacggaggaatgcatcatgaagtttttagttgtcggagctgggggagtgggcggatatatcggcgcgcgtcttgcagaaaagggaaatgacgttacatttctcgtccgcaagaaacgggcggaacaattacaagaaacgggtttgaccgtcaaaagtgcaaaaggtgatgtttcaatcaagccgaaattaatgttggcgggcgaagaaggagcatttgacgccgttatcatcgcttcaaaagcgtattctttgcaggacgtcattcgggatgtcaaaccgtttgtcaagccttcgtcggtcattattccttttttaaacggatacaggcactataaccagctgtttgaagctttttcaaaacggcaggtgctgggcggcctctgctttattgagagcgcccttaacgacaaaggggaaattcttcatacgagcgctgcccaccgttttgttttcggtgaatggaacggggagcgcacagaacgtatgaatgagctggaaaacgcatttgcaggcgtgaaagcggatgtcatcatcagcggggatattgaaaaggacatttggaaaaaatatatgtttattgccgcgcaggcgggagtgaccactctgtttcaacagccggtcggaccgattttagaaacagaaggcggccgcagcacggcaaagcgcctctttgctgaaatcggagccattttcaaggctgccggcatcccgaaagatcctggtctggaagaagagagttatcgcacattgacaagcatgtcttaccatatgaaatcgtcgatgctgagagatatggaaaagggcagggtgacggaaggtgatcatttacacggctttttgcttgagaaagcgaaaggcttgtcaattgatacacctgttttggaaaccgtcttcgccaacttgcaaatgtatgaagcgaaataaaaaggaggcctgatcgcctccttttttttattaaaatgcccagtttccgtttctgaagatcggttctcttttgccgtccgcggtaatgccgtcgatattcatttctttggaaccgaccataaaatctacgtgtgtaatgctttcatttaagccctctttgacaagctcttcccgtgtcatttgtttgccgccctcaatattaaaggcatacgcactgccgatcgccaagtggttagaggcgttttcatcgtacagtgtgttgtaaaataaaatatttgattgtgaaatcggtgaatcgtacggcactaaggccacttcaccgagatagtgtgagccttcatcggtttcgacgatgccttttaaaatctcctcgcctttttcagctttcacatcgacaatgcgcccgttttcaaaggtaagagtgaagttatcaataatgttgccgccgtagctaagcggtttcgtgctggaaaccgtgccgttcaccccgtcacgctgcggaagggtgaaaacctcttctgtcggcatgttggccatgaattcgtgcccgctttcattcacgcttcccgcgcctgcccatacatgttttttcggcagttcaatggttaagtctgttccttcagcctgataatgcagggcgctgtaatgttttttgttcaggtgttccactttttcatgaagattttgatcgtgttttttccatgctgccacagggttttcttcatttacgcgggttgttttgaaaatttcttcccataaaagctgaacggctgtttcttccggctgatccgggaacacttttttcgcccagcctgttgaagccgctccgatcaccgtccagctgaccttatctgattgaatatattgtctgtatgtatgcaatgcttttccggcggctttttggaacgctgcaatccgtttgccgtcagcgccttttaacaggtcggggtcggatgagacgacagaaataaacgcagccccttttttcgcgagctcttcttttccttttgcttcccattcaggatactcttcaaacgcttcaaaaggtgccatctcgtattttaatctggacagttcatcgtcctgccaatttacggtgacgttttttgcgcctttttcataagaatgtttggcaagcagtctgacaagttcccggacatcagttgaggcattgattacgacatgctgtcctttttggacattgacgccgacttctaccgccagctgagcatatgtatttaacttttcagtaaacgaactcatcgttcattcctcctcatcggtttttctcatcatatcaaatatcgcctcataaaggaaaggaaggagcacaaacgaaaaagacacagcttttgctgcgtctttacggatgattcagttttacggcgccgccggccggagaatggggcatattggccagtgaaatgctcataccccccaaaataattccgcttaaaatgacggctactgctacgcgtcttcccacatctctaagcatatgcttcctccttaatgtttctccagttctcacaatatgagccggccggagaaaaaagaagcacaatcttattatttaatcgctttttgcagcttgtcgatgacgtctaatgaacgtccagtgccgatagccactgattcaagcggatttgccgccaaatgaacgggaacgacgatttcatctgtcagccattctttcatcccgtttaaaagggagcctccgccggttaacacgacgccgcggtcaacgatatcaccgctgagctccggcggacaatcttcaagcgtcgctctgatcgcttcaagaatatgcaggagcgactcacgcatcgcgtgctgaatttcattagactgcagtctgattgtcttcggcagaccggttacgaggtcacgcccgcggatttccatcgtttccggcacatgttcgatcaatgcaaatccgatttccattttcacttgttctgccgtgcgttccccgatcagcaggttgtatttttttctgacgaacgaggcgatatcttcatcaagctggtcgccgccgattctgatcgagtggcaggatacgacgcccccgaatgagatgatggcgacttcagtcgtaccgccgccgatatctacgacgacgtttgcgaccggctcgtcaacagggaggtcggccccgattgcagcggctacgggttcttcaatcaagtgaacgtttttcgctccgcagtttttgacagcgtcactgatggcgcggcgttcaacggccgttgagcctgaaggcgtgcagacgacgacattcggtttgcggaaggtcattccgattttttttccggcttttttcataatgtgttttaataagtcagttgtcatatcataatcagcaatgacaccgtctttcatcggccgtacggcgacgattttccccggcgtctttccgatcatgcttttggcatccgttccgatggcaagcaccgctttcgttgttgtatctacagcgacaacggaaggctcatttaaaataattcctttatttttactgtaaacaagtatattagcggttcctaagtcgattccgatctcagttgattgaaacatgttttcacccaatccctatcctgatttaattgattctacatttaaagtttctgagaaaaaccacgatttttgggggtttccgccgggaatgaaatgtttttgtaaaaaaggagggaaagtctgtatcccgtatttcaaaaggctttcttttgtaaaaaacattcatttccggatgctgagaaacttttgctccgttcctttcgtctacgtttatgaaggattttccttggacataaagaagagacattaaaggaagtaggggatttctatgaaatcaattggtgtagtaagaaaagtagacgaactcgggcgtattgtcatgccgattgaattgcgaagagcattggatatcgctattaaagatagtattgaatttttcgttgacggagacaaaattgtcttaaaaaaatacaagccgcacggcatttgcttgatgaccggggaaattacctccgaaaatcaggagtacggcaacggcaaaattattttaagtcctgaaggagcgaaaatgctgcttgaggaaatcgaagaagcgttaaaagatagatcataatcagcaaaaagggcggggcatcattccgtccttttattatgaacttgtgcaaaaactcacgggaaaagtaagcgaacctgctcaattaattgggaatagttatcattttttagtcaataatgcagtcaacaatgttacaatatatgtagaaatgttagcggcaggtgggactatgggaaaatatcaagcgcgtatcatttccttaatcttggcaatgatttttattatgttttgggattatttattttatatgattgaacggaatccgattaactggcccgttgacatcacctttaccgccgtcacattaatcagcgtctggctgctggcttattatgtggacaataaaaagcagctgctggcggagctgaaggacagcgagcagaaagcaaaggcgctttcagatgagaaaaaccggatcatggacaatctgcaggaaatcgtttttcagacggattcacaagggaatattacatatttgaatcaggcctggacgacgattacgggccactccatcagcgaatgtatgggcacgatgtataatgattattttataaaagaaaaacatatcattgattatattatctcccaaatcaagcagcagtccccgtcaggaatgtttacggccaaatatattaaaagagacggcacgatcttttggggagaagtccattataagctgtattatgaccgcagacagaaatttgtcgggagcctggggacgatgtctgatatcagtgaacggaaaaaagcggtcgacgagcttctggaaacgaacgaacgccttgccatgcaatctcaaaagctggccattgccggggagcttgcggcaggaatcgcccatgaagtaagaaatcctttaacgtcagtcagcggctttctccagctgatgaaagcccagtatccggaaagaacggattatttcgatattattttttcggagattaaaaggattgatctcgtgctgggggagctgcttctgctcgccaagccgcagaccgtgacgtttaccgctcatcatctcaaccatattttaaggcaggtggcgacgcttcttgacacgaacgcggtgctgtcgaacactgtgattgagaaggatttcaggcagactgagtcctgtatggtcaacggtgacgaaaaccagctgaaacaggtatttatcaatattattaaaaatgcgattgaagcgatgcctgacggcgggaatattcatatttatacagaacgggatgaagaatacgcggtgatcagcatacaggatgaaggaaacggcatgtcgaaagaaaagcttgaaaatatcgggaaaccgtttttctccacaaaagatcagggaacgggtctcgggcttccgatttgtttacgaattctgaaggagcataatggtaaacttaacattaagagcaaaaatggagaaggcagtacgtttcaggtgattctgccgttagaagcggctgctgtccaaaaggaggaaaaataacttgcttctttttgtatacggtttgttacggaagcgtgaagaaaaccatgaactgctgaaaggcgctctatgtgtgtgcgagcaggccgcgataaacggtgtgctgtacgaaacggataaaggtcagcctgcggcgtctttagcagaaacagcttttgtgtacggggaattgtatgaaacagatcatcagatgatccgtaagctggatatgtattatgctgattttgaccggaaagaggttgccgtgacgacggatgccgggaataaaaccgccttcgcatatgtcgtaaagcccggccagtgtgcctcattcagccgtatcaaaagcggagactggaaagaataccgttttatgaaacgggaggatgacagtccggtttattatttcgcttacggctcctgtatggacaatgcccggtttaaacaggcgggggtcgaccacttctttgccgagccggtcggaggggcggttgttgaagggtattcgacgagattcacgttaaggcgtcctgacggttccagagccgatcttgttgaagacgggggacgaactgaaggcgtgctgtacaagctcccgtttgaagcggcaacctatctgtacaaaagagaaggtgttgataatcacacataccgtcccgcgttcatagaagtgtgtgccggcggccgtgtatacagaggcgtcctgacgtttctggttcttgataaagcggaggaaattgcgcctccgggtcactatcaggaagaaatcgaacgcggagcggacctgtatttatcacccgccttttcagaaaagcttaaacgctatatgaactcattgccgaaaatgtgatactattcctattagagatattgtttaaaggagtactgttatgagaaaagagtttgccgttatcggtctcggacgcttcggcggaagtatttgcaaagcattaagtgaagaaggccttgaggtcatggcgatggatattgatgaagataaagtaaatgaatacgccaaaatcgcatcacacgcggtcatcggcgattcaaccgatgaatcggtgctgaaaaacttggggctgcgcaactttgaccacgtcattgtggcaatcggcgaaaatatacaggcgagcattttaacgacgctgatcttaaaggaactcggcgtgaacacgatcacggttaaagcgcagaacgattatcatgagaaagtacttgcgaaaatcggggccgatcacatcgtccaccctgaacgtgacatggcaaaacgcatcgcccacaacatcgtatcaaataatgtgcttgattatttggagctgtccgacgaacacagcattgtggagatcgtggccaacagcaggcttgcgggcaacacactgcttgatctggacatccgggcgaagtacggcattaatatcgtggccatcaagagagaaaaagaagtgatcgtatctccgctggcgactgaaatgatccaaaaagaagatattctcatcgttatcggctctcttacggacatttcccgatttgaaaaaagagtgcttcatacaaagtgaaaagccgtccgtaaaaggacggtcttttattatgtcagaatagaaagacatttatcatgtaagcggtatattctgcaatttttattgactatgatcaggcgatccgatagcatattgtaccatataaagaaaaagaggaggccgcattttgaacaaagaaacactggctgaacggctgaatgcatcagccggcagacaaaaagccgataccgtcattaaaaacggaaaaatcatggatgtatttaaccaggaatggatttctgcagatatcgccattacgggcggagtgatcgtcgggctgggcgaatatgaaggggaagaagtcattgatgcagaaggccaaatgatcgttccgggctttattgacggacatgttcatatcgagtcctctatggttactccgattgaatttgctaaagccgtcctccctcacggagtgactactgtcattactgatcctcacgaaattgcgaacgtttccggagcaaaaggcatttcatttatgatagagcaggcgaaaaaggcgccgctgaacatccgtttcatgcttccttcctgtgttcccgccgctagctttgaacgctcaggagctgtattaaaagccgaggatttaaagcctttttatcaggagaaagaggtgctcgggcttgcggaagtaatggattatgtgtctgttgcggaaggtgaagaggatatgcttcagaaactgcttgatgccaagcgtcacggaaagcggatcgacgggcatttagccggactgtcttcagatatcatcaatatatacagaaccgcaatggtgtcaaatgatcatgaagtgacgacaaaagaagaagcgctggacagaatcagacggggaatgtacgtcatgctgcgcgaaggatcggtggcaaaaaatacgctcaacgtgctgccggcggtgaatgaaaaaaacgcgcgccgctttttcttttgtacggatgataagcatgtagatgatctgcttacagaaggaagtgtgaaccaccaagtcaaaatggcgataaaggcgggacttgatccattccttgcgtatcagctcgccagcttaaatgcggctgagtgctacggccttgaaacaaaaggggcggtagcgccgggttttgacgcagatctgctgttcatttcagatgtacgggaggctgccgtcacgaagaccatggtcgccggccggaccgttgccgagaacggacggacggtttatgaacagtctgccggttcctattcgccggaccaggcactgttggatacagtgcggctgaaagcgccgctgactgaatcggattttcatataccgattcaagagggcaggaaaatgaatgtaatcgaaatgataccgaatcatttggagacgagaaaaaaagaagtgcctgcaccgtctgctgacgcgtttcgacctgatacagataatgatttattaaaaatcgccgtcgcagagcggcacagcggcgaaaaaatgataggactcgggattgtacaagggttcgggttaaaagaaggcgccatcgccacaaccatttctcacgattcccataatatcatcgccgtcggtacaaacgatgccgatttggcaaaagcaatcaacaagctccgtgacaccgggggcggattaacagccgtgaaaaacggagaattgcttcactccgttccgcttccgatcgccgggcttttgtctgataagtcggcggaatgggttaatgacagcttgggcgtgcttcatgaaaagcttcctctgcttggattcaccggtgatttcaatccgtttctcaccttatcgtttttagcccttccggtgattccggatattaaaatgacggcggccggtctgtttgatgtcaaagcctttcagcatattccgctgcaataaaaaaactgcactcgtaatgagtgcagtttttttagacctccataatgatcggaaggatcatcgggcggcgttttgttttttcgtataggaacggagcaagcgtatcggtaatttcgtttttaatttcggaccactgcgttgttttccgatccattactttctccagatggtttgaaatgagctgctgcgcgtcattgatcaaatcaccggattctctcatatatacaaaacctcttgagattaaatcaggtcccgccgaaaccttaaagtcgtccatattgatgctgacaacaacgataacaaggccttcttctgaaagaatgcgacggtcgcggagcacgatattgccgatatcaccgattccgcttccgtcaatgtaaacggagcctgacggaattttgcctgccacagcggcttcttcgcctttgagggccagcacttcgccattatccatgataaaacagttttcttcaggtatgccgcaatcagtcgcgagtttgacgtgcattttctgcattctgtactcaccgtgaatcggcataaagaacttcggtttgatcaggcggagcattaatttctgctcttcctgtccgccgtgtccggatgtatgaatgtcattcaatgaaccgtgaatgacttctgcgcccgcacggtacagctggttgatggtgcggcttacgctgattgtgtttccgggtatcggagaggaagaaaagacgaccgtatctccgggattaatggaaatctgccggtgcgtcccgttagcgatgcgtgataacgccgccatcggttcaccttggctccccgtacataaaatcgttaccttattggcaggcatacgattgatttcgttatgctcaataaacgtatttttaggacaggtaatgtaaccgagattttgtccgatttcaatagccgattccatactgcgtccgaatacggcaacttttctgccgtttaaaacggctgcttcaatcacctgctgaagacggtgtatattcgaagcgaatgtcgcaaatataattctgccgtccacttttcggaaaatatcgtgaatgctttcgcctacgcggcgttctgacatggtgaaatcaggcacctcactgtttgtactgtcagaaagcaggcacaaaacgccttctttcccgatttcagccatctttgtcaagttggccggttcgcctaccggtgtgaaatcgaacttaaagtccccggtatgtacgatattgcccggcggtgttttgacgacgattccgtatgaatccggaatgctgtgtgtcgttctgaagaaggatacagacgtcttgcggaacttcacgatgtcgtcttcaccgatgatgtttaatttggtctgtcttaacagcccgtgctcttcaagtttattccgaagtaagccgatcgcgagtttaccgccgtaaacgggaatatttacttgtctgagcaggtacggaataccgccgatatggtcttcatgaccgtgggtgataaacagacctttaattttatcttcattttttactaaatacgtgtaatcggggattacgtaatcaatgccgagaagttcatcttccgggaacttgattcccgcatcaatcagtacaatttcatcctgaaactgcaccccgtacgtatttttcccgatctcgcccaatccgccgagggcgaaaacggcagtctggtcattttttacaaatttcattccgctcataactccaatactttaaaattttcgctctgcttctcatattctaaaaaagcaccgtccacaggctgaacaaattcaatgttgtatttctgatctttcagtttcgttctgacgtcccgttctgaaacgccctcaatgtaaagtgaatctgttttttcccgaacaggtacttcgtcagccttctcttgataaaataccttataaatcatccaaatctctccttaaatgccgtatgttagactcgctgattctattatattcgaaaacggattataaggaaagtctcgagcaaaaaagggactttcaaaaaccgaaagatcccttctatgcgatgacttttttccggagcattccgccccactgtcttctgagtttcttccgtaatcggcgcagcatcgtatacctcctttaaagccctttatagcagtagtatgcggaaaaaatgaatttgttttcgtgggtaaaactggaatttcatcaaggcggttttccggaagaaaaactttctgtatgatgatattgaaaaagacacgactgataaacgggaaaaaggagaaattgacatgaaaccaaaactgatcttttttgatattgacggcacgatctatgaccatgataaacatattcccgatagcgcaagaaacgccgtgacggcgcttaaagaggctggacatcacgtttttatcgccagcggaaggtccccgtttatggtaaaaccgattctggaagagcttgagattgaatcatttatttcatacaacggccagtatgtcgtatttgaaggtgaggtcatttataaaaatccgcttcctgaagatgcggttgcgcgtttattaaagcaggcggcagaaggggagcaccccgtcgtatttatggcggaagacacgatgaaaacgaccgtccccggacatccgcacgtctcggaaggtatcggcagtctgaaagcgccttatcccgaagttgatgaaacattttataaaggaaaagaaatttatcagctgcttttattctgccgcggacatgaagaaaaagcatatgccgcttttccggagtttgattacgtccgctggcatgaattgtcaacggatgtgcttccgaaaggcggttcaaaagcggaaggcattaaaagagtgcttgagcggcttccgtacggcgtaagtgacacttatgcattcggcgacggactaaatgaccttgagatgatccgttttgccggcaccggggtggcgatgggaaatgcggttccggaattaaaagctgccgccgatttcgtcacaaagccggtggatgaagagggaatcagctgggccgtcaaagaactgggccttttgaaataaagaaaaccggcactttgggaagtgccggtttttttaacggtcaatggcaatggcgttttcaggttctttgaacggattttctttatcgatatgatcgtaaaacatcacgccgttcagatgatcgatttcgtgctgaaacacgatggccggaaaacctttgaggcggatgtcaatctgttctccttcaagcgtcaccgcctttacgcggatgcgggcgtagcgcggcacatagccgggaatgggttcgtctaccgacaggcagccttctccgctcgtcaagtagcttttttccactgagtggctgacgattttagggttaaaaagagcatagctgtataaagtgcctttcgcatcttctgcatggacggcgatcatccgtttttttacgtctgtttgcggagcggcaagaccgacgcccggacgaagcttgtatttctcggctaattcaggattttggctgtttttcacaaactcaatcatatcagcaagatgctgtttttcttcgtcggaagcgggaagctgaacctcttcagcgatctctctgagcgcgggatgtccgtcgcgtacaatattttccatagtaatcaagaaacttcactcctaaagcttaatatgtaaattatagcgaatttctttatcgcggcgcaacgaaacaattggccggccatagcaggccggccgattttcatggtgtataaggtcagcagccgcagcctaaataagcggcaccgacgatgattaataagataaacaatacgacgattaatgcgaatgtgcggccatatccgccgccgcagccataaccgtaaccgccataaccgtatccgccgcagcaaccgccgccaaatccgccgccaaatccgccgccaaatccatatccgtacataaaaaaacctcctcttttaattacgctgaccctttgtcagcagggccggcgtctactataaactatgtaaaagccaaaaagatgtatggtcatccgccctgttttctcaattttttacgcaagtattctttgacagcaccgtaagcatctttttacccggtcatgccaattacagctcagctattgtcaaaaagcgttcgggcttctatagtggaaattgtcaagattgggggattttaagtgaatatgattcaaaaaaaggtattagcaggaatcggagcgctcggcgccgcaagtatgctgcttgcgggctgcgggggaaaagatccggttgaatcgcttcatgactcgatggaaaaagccgttcaagcggaaaaaccgtttcaaaaagagcagaaaacattggaaaaattggagaaaaaagagcacaagctttacgacagcgcggttaaactgaatatggatgattacaagaaaatcgtcacactgtctgatcaggctctgagcaatgcaaatcagcgaaaaaaacatctgaaagcagaaaaagacagtattgatgattcaaaaaaagcatttgaatccgcaaaaaaaacttctcaagaaataaaggataagaaagtaaaagaaaaagccgggcatgctgtcgctttaatggaaaaaaggtatgcatcttatgatcttttgtacaaaaagtacgaaaaagccatttcacttgatcaggacctttataaactgattaaagataaaaagctcacattatcgcagctggaagagcaaatcggcaaagtaaactcagtttacgaaaaagtgcataaacaagcagatgagttcaatcaatttactaaagactacaacaaagagaaagaactattattccgcgaatagtatagtgaaggcatatcggcatgggctgatgaactgataacaaccgagttcagccgcctgtaaatggcggctgaagaattggtatatacgtgtgtttcccattgacaacatgtaaatcatggtatagtatttatttagggaaatattcacataaaaccaatcgttgtttcggcacgttgggatgtttttattatattgatatataaaaaacagaatgaaaatgcggttttaattatcagaaaattctatctattatttgcggcaatatgatctttgtacatgctttttgcttttaaacctttatccggcataaaggtttttttattttgcttcgtaatgcttattaagtaatggtgccgggtgcttagagtaaatgacaattttaaaaattgaagtgaaaaatgttaaacaaatcacaatcggaacgaaaagaaacggcagaaatacggaacaaggaggaaaacaaatgcttgcttacgtctttcccggacagggagcgcagtttaaaggaatgggcagagacttattcgatgaattcagtgagctcattaaaaaggcagatcatattttaggatactccataaaggatttatgcctttcagatgaaaaagagaggctcactgatacgaagtatacacaacctgcaatttatacagtgagcgcactgcaatatttaaagggtttaaaagaaggtcatactcgccctgatgctgttgcaggacatagtctgggtgaatatactgcgctttttgcggccggtgtttttaattttgaaacaggtctccggctggttgctaaaagaggcgagttaatgagtgaggcttccgagggcggaatggctgccgtgatcggactggatgagcatcacataaaaaaaatacttcaaaagtatgaattcggccaaatagatatcgccaattacaatacatcttcacaaattgtgatagcaggggctgcagaagagataaagcgtgcagcctctttttttgaaaaagaaggggcgaaagcttatatcgtattgcaagtcggcggagcttttcattctcgtttcatggaaagtgcacagcgtgaatttgcggaatttatcggggagtttcatttttctgaattgaatttcccggtcatctctaactatacggcaagaccttataaacaagaagatatcaaacggaatttaattgaacaaataacaaactcggtgaaatggactgaaagcatcaggtacttaatgggacaaggcgtcactgtgtttgaagagatcggtcccggaaacattctgactaaattaattcaaaccatacaaagagatgaggaaccgcttaatattagtgcgccaaaagacagtctcttgttttctgaagggaacaaggacaattccgaaagcgggaaagagaagggcctcatggccgaaaatatagaaagcgttgcggcttcaccggtgtcccgattgggtgatcaatctttcaaagaagattacggtttgacatacgcgtatttggcaggtgcgatgcatagagggatctcttccgctgaaatgctgatccgcctcgggaagaaaggaatgctggggttctttggcacagcgggtttaactataagggaaattgaacaggcccttatttctattaaggagacactcaaaaatggccagccctacggaatgaatctgcgatttgagccggatcatcaagatagagaaaaggaattgatagatttatatatcaagcatgacgtacgggtaatagaagcgtcttcgtatctttccgtcagcgcgccattaatttattacaaagcgcatcagttgaagatggacaaaagcggcagggtcatacctcataatcggatcattgccaaagtttcacggccggaagttgcggccgcatttctgagtccgcctccccaaagtatcgtaaagagaatgtgtcagcacggtatgctgacggaagagcaggcggagtggctcagccgtgttccgtcagcagacgatatcattattgaagcagattgcggcagtaataccgaacagggctcattgacggcgatgctgccgttttttgttaacctgcgggatgaaatgatggaaacacataaatacgcaaggaagatcagagtcggggccgcgggaggaatcggaactcccgagtctgcggcgtctgcttttttaatgggcgctgattttattatgacgggatccattaatcaatgtacagttgaagccgcaacaagcggttttgttaaagaaatgctgagtgagacagaaatatgcgatactgcttatgcgccttcggagactctgtttgagttcggaacaaaggttcaggtgctgaaaaagggcacgctgtttccggtcagggcaaataaattatttcaaatctaccaacaatatgagtctttgagtgagatagatgaagagacaaagattcagctcgaaaatgtttattttaataagacttttgatgaaatctacgaaagcataatagaaaaacagccgaacctggcccaaaaagcggagcgcaatcaaaaatataagatgctgttactatttaagtggtatttgcagagaggatgtctgcttgctttggaaggggaggaagaacaaaaggtgaatttccaagttcattgcggcccgtctttaggcgcttttaaccattgggtaaagggcacggagttggaatcatggagaaacagacatgtcgatgacattggtgaaaaaatgatgaatgagaccgaaagtctgctaagacgcagattggatacgttatttctacactaaaaaggggcgggtggaggccaatggttcatttgaataaacagagtgcggatatcgcgataatcggggttgcttgcagattccccgatgcagatcattatcatgaattctgggaaaacataaatagcggcaaagattccatccgggaagtgccgattgaacggtgggatcccgatctttattactcagctgatatcagtataccgaacaaaacaatcagcaagtggggaggttttattcataaagctgaccatttcgaccataagttttttaatatctctccccgggaagcgaaaaacatggatcctgagcaaagaatccttttagaagaaacttggcggtgcatcgaagattccggggtctctttgcgggatctccagcgtaaaaccacttctgtttttgcgggtattatgaattctgactaccggcagacaggtcatgaatcggaaatcgacagttacgcctgtttaggaagtttcgaagctatgctctccaaccggctttcatacacattcggtttgaccggaaaaagcatgtctgtaaatgccgcttgtgcatcgtcgcttgttgctttacatgaagcggttaagtcattgcggacaaaagaaagcgattatgcaattgcatcgggagtaaacttgaatttccaacccggaaaatatatttctttttctaaagccagaatgctgagtcctgacggcaaatgtaaaacctttgacgcagcggcgaacgggtacgttcccggagaaggggcaggcgttgtattgctgcagcgccttggtgatgcagtaaaagccggtcaccatatatacgggatcataaaagggacggctgttaatcatggcggtaaatcccgttccataaccgctcccagagcagaagcgcagtgccgggtcatctcagaagctttacacaacgctgctgttgatgctgcgacggtttcttatgtagaagcacatggtacaggtacatctctgggcgatccgatagaaatagaagcattgacaaaagcatatcggcaatatactgaggatactcaatattgcagaatcggaagtgtgaaaacaaatatcggtcatacagaagcagcggcgggaatggccggattgataaaagttctaatgatgatgaaacatcggagggtgccgaaaagcctgaatgtacatacggtaaatccaattatacagtttgaaaaaacaccgtttaggccggcgcttgattcaagtgattggaaggcggcagacggggctccgctcagggcgggaatcagctccttcggttttgggggtgttaactctcacgtcatcatcgaagaatttatacatacaaatgacgaaactgacagaaaggtaagggctcccttccttttttccgctaaaagtgaagaaagcatgaaacaaatgatacataattggagaaccttttctgacgattctgaggaattttgcaaaatatcaaatgaagcgatcagcagcacccttttaacaaggacatcgtttgattacagggcgggtttattggcaggcagcaaggaggaatttaaaaatcagcttaaagagggattaagttttcggaggaaacatgattctgaatgggcgcttgccatcggtgacttcaaatgggaaagttataaacaatttgccgttttgaaacgcgtgttccctgatctagaaaagaacgtaaggtcggtgctgaagggtataccagcattgcacagttcatttaaaagaaaatggacgcctgagaaaatccgcttgtattctttagttatcaatacggaaatcataaaaagtatcctggcatccggttttaagccaagtctcattacaggcgccggagacggatattacgtcgctcttgcagcagcggatatcatcaaaattgaaaaggccatttctgtcatcacaggcgctgaaaaaccttcgcacttatcctgcgagccgccgtccattccatttgtcaatccgtacacttcaaaaacgtacccgccggttcgattaaatgaagaatatgtaaggatgctgctgaacggtctgagcttcccggctgattttacagaccgcctgtacgggaaaacacggctgcttcttgagcaccaatatacgtttaaagggtttttagaagagtgggataaagcgggaaagactcaggaaatcgagattttatcttatattgtgaatcgcacggcggataaaagaaacgcattgccggctgaagaggaagcggcgatcatggctatccttgcctctatgagaagactgtataagagatgggatttaacagattatgatggattctttgataatgattatgttctggaaatattaaatttactggatgaaggaatcttgtctaaagaactttttctgagcatgttattgaaaaagcaagacggaattaaacaggctgttgcttgtatgaatgagcagccggcaggtttttatgataaggcccgttttccgctgatgacagaatacaatcagatggatgccgtgtttcaggagatagctgaccatatgccgcttcacacggaagaaaagggaacggagccggatgtgaatatctctgatttttcagtttttcaattcggatcgctccctccatcagcaaaactaaacaaagcggctgcttttgaagcggacaaaccagctgatgaggctctttatcattcatttatgcaaatgtggctttcaggagaagagattgaatgggcgaaactaggtgattatcataaaagaaaagccccgcttccgccttatccgtttgagcgctctcaattttctttaaaccctcagccggtaaaatcagacgcggctttttcagaaaagaagaatcaggcactttatacgccggtatggaaagaaaccgcacttgagaatgaagcgggcagcggacaagcctgtactattttgttgttctccgggaataaagactattttgaagagctgaaaaaaagagagaatacgtccgcatatcttattatgcccggtgaccgtttagagcagataagcgacagtgttttcaccatcaacaggcagtgtcccgaagattatcaaggtgtcattcgtctgttaaaggaaaaaggcgcagcgcccgatgcaattttgcatacttggtctgaaaaacagcctgaactggaagaaacactcgcatcaggaatttattctgtgttttatctgactaaggctttaatcagcgagaaccttataaacaaagtaacgttcatttatacattcagcgcagatcaaaaagaaaaattgccgtattttgaaggtgtgaacggttttttaaaatcggtaaaacaagagtacccgcagctgcattgtaagacggtttgctttgaacatgattctgcatccgtttcatgttcagagaaggctgacattctttataaagaaataaacacagcgcctgatcggcatattcatatcacttacagaggctgcgtaagatatgcacggatgttagagaagcagagagaaacaaacagaaagaccattcaataccctgaaaaagataaagtatatttaattacaggggatttggggggattggcagtaaaatcgctgaatattgcgcgaaaactgaaagatccaccattatcctatcggggcgatctgttttaaacggagataagcagaaacatttagaatacctgaacagctttaaagccaaggtttattatatacaggcgaatatatccgataaagaagcggtaaaaaaaatgattgacggtattaccgatcagcatgcaggtcttcatggcgtcattcattgtgcaggagttatcagagactcgctgctttttcgaaaaacaaagcatgaactttcagaggtgattgctccgaaagttcatggcgcattgaatcttgatcatgcaacgaagtcgctcgaattagattttttcgccgttttttcttcagtcgtctctattgcaggcaacgaaggtcagtgtgattatgcatatgcaaacggctttttagatcattttgccgaatatcgggaacagaaacggcaaaattctctgcgcagcggccgcaccctgacaatcaattggcctttatggcaagacatcggaatgggggcgaacctgtcaggtcaagggcggacgtctctttttcatggttcagggctcgaagaacttcctgctgaagacggaacgcaatggttttcgcggattgtaacttcgggtcagctgcataatattgcagtctgcggtgatcatgaacgctttgaacaatttatgcagcagagatttttgacggacgaaacagagacaggcagtgccgttcctttggctcaaggcgatattttggatcagacagttttgtttttaaccaatatcatctcctgtgaggtcggtgcagaacgggaagagatcgatcaagatgtgcatctggctgaatatggaatggattccgttatgattcatcaatgcaacacaaagctggagcagtcactgggagcaatttcgaaaacgcttttatttgaatttcatacaatcagagatttagcagatcatcttgtaaaagaatacccggatcggctgggacgtttattttcacgggaggaaaaaggaaaacagattcagagcattacccccgccaggccggaacaaaacaccactgcatctgcggcggaggaaaaagaacatcttgacgggatagcggtaatcggtatcagcggccgttatcccggggctgaaaatatcgaagaattgtgggatcttctatcaaaagagagaacctcaatcacagaaattccgaaagaacgatggaattatgagacctactatgatccagatcccgctaaagcgcatgaggggaaaatttattgcaaatggggcggatttttaaagaatgctgaatcatttgattctttgtttttccaaatatcgccgagagaagcagaagcgatggatcctcaggaacgaatatttctcgaaaccgtatggaaagcatttgaagattcgggatataccattgaagggttgagaaagcagaccgaaaaacatgtcggtgtatttgcgggagttacaaccaattcttacaagctgctcggcgaaagaataccgacggacaaaaacgatgtacttccaaattcgttcccgtggtctctcgcgaacagagtgtcttacacatttgattttacgggtcccagtatccctgtagatacggcttgctcttcatccttaacggcaattcacatggcttgccaaagtttaaaaaaaggtgagtgctcggttgcggttgcgggaggagtaaatttgtatcttcatccttctgactatttataccggtgtcagatgggaatgctttcaaaatcgggaaaatgcagaagttttggagaaggcggcgacggtttcgtgcccggagaaggtgtcggggccgttattcttaaaccgcttaaagatgccatacgtgataatgatactgtgtacgccgtcataaaaggaacggcaattaaccatggcggaaagacgaatggctatacggtgcctaatcctgccgcacaggcggatttaattcaaggagctcttaaagcggccggttggagcgccagaagtgtcagctttattgaagcacacggcacgggaacgccgctgggtgacccgattgaagtccgaggtctgaccaaggcgttcagagcttataccgaagatgtttcatattgctctctcggatcgattaaatctaacatcggtcatctcgaagcggccgcgggtattgccggcctgacaaagattattttacaaatgaagtataaaaaaatagccgcaacactgcatgctgaacgggtgcatccggatctttatctggaagagacacctttttgtctccagcaggaaactgccgactggataaaacccgcgaatgaaaaacattctgacagcaaatatccgcggcgtgcgggattaagttctttcggagcgggcggggcaaatgctcatattcttgtggaagagtatgagtctgctgctgactgtcaaacggggcgtgaggaaagtgaagaacttatcgtactctcagccaagcattcactgagtttacgggaatcagcaaaaaagctggaggaatatcttcaaaaggctcgtcataagcagggcgagtgtttacagccggcgggaacaaataagccgcttcacctttctgatattgcatatacccttcttgaagggcgggaagccatgccggaaaggcttgctgtcatttcgaaaaatatcgatgacctgatgttgaaattaaatcacttttataatggaattgacgatcacgaaatattcagagggaaaaaaccgaatcataaacgcggacagcggcaatcggatcttccgctcaattccggcagaaccacattagccgacatggctgaattctgggtatcgggagggagtttaagctgggaagatttccgcaccggcagaaaaccggcaaaaattgcgctgccgacttaccctttcttaaaaaacagactgtgggtgtcaaataaggcgcaaacaacatcagcagccggtacagctcctttatttgatttttctgccggtgagtgccgattttataaaacgctttcagattctgaatattatttaaaagaccatgttgtgcatgggaatatggttctgcccggagcggcaatcatcgaagcggccagagaagcgggagagaggctgtacggaaaatcagtcataaaactgagtcaggttgtatgggcggttccgataaccgttgaaaaagaaaagacgataatgatagatctgctgccgaatcaaaaagacggcagatttgtggtgaaaaccgatatgcaatctgaagcggcagttcattgccaaggaaacattatgacatgcggagataaagacgcctctcatacagagcattttaaattggacagctggttaaccggacagaaaagattaatcagcggcgctgagtgttatagaaacttccggcagagcggtttggactatggagccggctttcaggtaataaaacagctgcttatccatgaaaatgctgttcttgcacgaatatcacttcctgagagcattgataaaaaatccggcgggctgctggaaccgtgtttattggatggcatttttcaatccacaatcgggtttacgtccggtcaggaagacgatcataccgcatatttgccttttgaattaggtgagctggaaattcttcaaccaccttcggcaagcggctatgcttacattacagctgccgatgaaagacaacatgatgatgtcaaaaggtttcatatactatttatggatgaacacggatctgtaagtcttaaaataaaaaacttagcgttgaaggcattaagggctgcaccgcagactcaaaatgagcggcattcagctaagtattactctgatatgtggaagcgggcccctatgcttcatcagcctgaaggcagcggtttaaacagctgccttgtaatttcactccgtcaggatatatcagaaccgctgatccgccaggcatataaagatatcggcctgaacatgatctttgtccgccatggcggaagttttcaagaaaaagaagctgattcctttgaattgaacagcgtcaaacttgaaggctataagaaattgctggcgattcttaaagaaagacaagtgacaattgaccgcgtcattttaatcgggatgagccctgaaacgggaattgagcataacattcatgaaaagctggaagaggctgttttgccggttttcaatgtaacgaaagctctgttagcaacaatcccaagacataaaattctgatatcacatgtatttttcacaaggaacaatcaaatcttaccttatcaaatggcaatcagcggcttttttaggtcgcttcatttagaacatccaatgttgtccggtaaaaatattgaaatacacagcgatgaaattcagttacagctgaacaccggtctgcctgaattaaaaaaccttgtgaaagaaacagtcatcagcgatgatgcttcagagatcagatacagagatggaatcaggcaggtgaaacactctgcagaaattgaaagggcagagcccccaaaaagatggaagtaaaagaagggggagtttaccttattacaggaggaacaggcggcctgggcctgatttttgccagacatcttgtgcgaaaagggagaataaagcttgtgcttatcggcaggtcagagctttctgaggaagccgtaagcaatgtaaaagagctcgaaaaaaacggatcagaagttttttatgtaaaaaccgatatttctgataaggaaaatgtcaacaacctgataaaactcgtcaaaaacaaattaggtcctgttaaaggagttattcacagcgccggtgtgataaaagattcattactcatcaataagcgtgaagaggatctcgattcagtcctggccagcaaggtttacggaacgatatggcttgaccggtatacagacagagaacctctggacttttttgttatgttttcatctatcagcgcaataatcgggaatgccggacaaactgattatgcttatgcaaaccggtttatggattactttgcggaaatgagagcggcggaaaataaacctggaaaaacagtctcgattaattggcctttatggaaagaaggcggtatgcaaattgacattcattcagagaagttcctttatgaccgtttcggaatgctgcctctgggaaaacgggaaggccttgcagcatttgatcaagcaatgacagggtgtgaacatcaaataatggtatttagcggtaatgaattaaagctggaacgaatgataacgattgacagcggaaaaagtgacccggcaatcgccgacgaaaatcacgaaccgaaagagctgtcaataactgaatctttaaaaagcactttgacgcgcatcatcaccggcgtattaaaaattgaagaacgggaatttgattttgaactgccgataagtgaatacggatttgattcaattatgtttacaatgctgggcaacgaattaaacgaaacattaggaatatcaatgatgccgtcagattttttcggtcttactgattttaatgaacttcttgagtttttaaagagtgagtattccgaagagcttcatctctgcggatctttttcttcagatgaatctgcggcgaaagacaggagagaaaatctgattgagggcatcgcaaagatgatgtccagtattttaaagattgacagaaaggaaatggaagaagagacttcattcggcgagtacggatttgattctattacgtttaccagactcggaaatgaaatcaatcaacaatatggtacggaattattgccgtccattttctttgaatgcaattcactggctgaactgactgattatgtaatcgagcaatacggagaaatcctttttgctgagacagaacctttttctgcagcagacgaaaaaacattgtacagcacgcctccgccggaatcctatgaacattcccctgagcctgaaaacaaaaccaggcaagaggaaagacatatgaatgagccggttgcaatagtgggaataagcggccgtttcccccaaacagatacgctggaagacttttgggaaggaattgaaaaagggcgggatatgattacagacattcctgaagaccgttgggactggaaagagtttgacggcgatccgatcagggacgtcaatagaacaaaaataaaaaaaggcggatttatcaaaggcgcggacagttttgatccgttgtttttcgggatttctcccgccgaagcagaattaatggatccccagcaaagaatttttatggagactgtatggaaaacaatagaagatgcgggctataagccgtcagatctggcagggacgaaaaccgcggtgtttgcaggggtcgccacaacggactatgcggaacgtctcaatgaaaatggcgtctctgttcaggcgcagaccgcaaccggtttaaatcattgtatattggctaatcgtatttcttaccagctgaacctgacgggtccgagcgaaccgattgacactgcctgttcaagttcattagttgcactccatcgtgcggctgaggggattcaaagaggcgattttgaaatggcgattgcaggcggagtgcatattatgacaagccctactctgtttatagcttttgataaagcaggtatgctttccaaagacggaaagtgcaaaacgtttgataaaagcgctgacggctatgtaaggagtgaaggggcggctgcagtactgcttaagccgctcagcaaagcacaggcagacggtgatcatatttatggtttgattaaagggtcagctgtaaatcacggcggccgcgccaattctttgacagctccgaatccgaacgcacaggcggacttattaaccgaagcttggcggaaggcgggggtcagtcccgccactgcgggatatatagaagcgcatggcacagggacaagtcttggcgatccgattgaagtaaacagcatcataaaggcatttaaaacgttatatcaagaatgggacattccttttgagaaacagaaaagctgcggaatcgggtctgtgaaaacaaacatcggccatctcgaaaccgctgccggaatagccggagtgctgaaagtgttactggcttttaaatatcgcaaacttccgggactcgcccatttttcagaactcaatccatacatcaaaatggaaaatacgccattttatatcacagaaaccgctcaaaagtggaatccgataaaagatgaagagaacaacgatctgccgaggagagcaggtgtcagctcattcggattcggcggtgtgaacgcacatattgttttagaggaatatagggaacctcaaaaagaagtaccggaaaacaacggtaaaacacacatttttgttttatctgcgaaaaccaaagatcaattacttgagtatatccggcttatggttcagtacttggatcgcgtgattgccggtgacatgaccgttaatgccagtgacatggaatttacattgcaaaacggccgggaagcaatgaacgagagaattgccgtatgtgcagtgagtctgactgagctgagagataaatacgtcagctttcttgataaaagcaaggtgcaaaatggcgtatttataagcgaaaacactgaagagcgtgcagctgtttctgaatatatgattcaggaggctcttcaaagcggaaaggaggagctgctcgcacaatggtgggccaatggagccgagtttgaatggaagaccatcggcaatgagaaattgaatagagtgccgctgccgtcttatccgtttgcaaaagagagttattggtttactccgaaaaagaacaaaggcgaggttaatagcaaaagtcttcacccattaatcagcgagaatgtctcaacattaaagaaacaagcatttaaaactgttatttccggaactgaatttttcgtcactgatcaccttgtttcaggagactgtgtgttgccgggagccgcttcgcttgaaatggctctagtttgtgcggaaataagcggagaaagtaaagtatataaaataaaagacgtgatgtggaacagacctatattatataaaggaaaaacgctgcacatttataccggcttggaaatgaaacaagataagttgaacgcaacgatatgtaaagagggcccggatggcgtgcagcaaatctgcacacaatgtgaaacagtattcggagacataaacagcaatcctgagtatgtcgatattgatcagttcatacgcagcagtaaaacggtcataagccggaaagagtgttatcaccgcttcagtcgtatgggcctgacatatcagagcggttttcaaacgttgaaagccgtatatcgcggtgatgtggagttaatggcagaattggagcttccggatcatttagcgaacgggttttcacattttacactccatccttcattaattgacggcggttttcaagcggctgcatttttgttaagagaaaatgagaaagacggcttatttgttccttattcacttagagagcttcacattaagagggcgcttactgcccgatgccatgtttcggtgagagaaaccggtttttatacgtataacattgattttattaacgagagcggcgaagtagccgtgagcatgaaagacttctctgtcagaaaagtgaccgggggagaattaaccgcaggtcataaaaatgaagatcaggaaattctcttcttattggaacaattgaaaaacggtgaactttctgctgaccaagtttatcagctgctggagggaaaatagtgcagatcaaacaaatactttccttaattgaagaacagcaaatgtctcctgatgcaggactggagctaattcgtacttacagaaaacaacaaatggaaaaaaaggcggagccggaatcacaagctccgtccccaaccattttttttaagaccgattgggtcaggacaaatcacattgatatgccgaatcagcaggcaccggggaatatgctgatttttgatcaggataaccgtctttttcagcatgccgagatgatgaatggagaacataaccgtgtcattcttgtaacgcccgattctgattacagaattgaacggaatagatgcacaatcaatccttctgatgaacatcatgtcgaaatgctgctgtctgatttggctgaaaacggatttacacctgatgtcgtgctttatttatggaatagagaaatcagagaattcactgaagaatctgttaatgaatctcttcgcagagggataaactcgctctttttattatcaaaagctttaatgcgaagaaacgaacctgttacgttattgcatatttattggacaagcggtctgaatcagccgtttcatgaagctgtcggagggttcgtgaaaacggtaaacatggaaagctccaagcttaaagcgaaaaccatacagatacgccacgaggattctgacataaatcctccggtttccgagatgtgggatgctgcaatcagtgaaatgcagcgcattcaaacggatgaatgtgagattttaatagactcatatacccgttatgtgaaagggctgcagcctattgatattccggaacacgataacggatctgtaacgtatcaaaaaggcggcatatatatcattaccggaggagccggaaaactcgggctgctgtttgcggaacacatcgctaatgaaaatcaagccgtgattatacttacaggccgttcttttttaacagctgatcaaaaagaacggatcagtatgcttaatgagagcggctctattgttgaatatcagcggacggacataacagatcgaacagaggcagagcgattcattttcggcattaaacagcggtacggcagcataaacgggatcatccatgctgccggcatccttcgtgattcatttcttgtaaataaaagtcccggtgattttacggacgtactgaaaccgaaagtttacgggacaatctggctggatgagctgacaaaagacgaagatcttgatttttttgttctcttttcttctttttccgcttacggaaatgccggccaaagtgactatgcgtacgcaaatcattttatggacagttttgcaatgcttcgatcccagctctctcgaaacggaaaaacactatcaatcaattggccgttattgaaagatggcggaatgagtctcgacagcagtggaatcgttcaaataaaagaaaaatacggaatgactccgatgcgaacttcctctgttctggaagcgtttctgaaaatgctgcggtcttcatttaccagcttaatgcctgcagaaggtgagcgggataaaatgataaaggcgctttcgattcaaagaaatacagctgcagcagatcaagatacactcacggcggaacacgatgaagaagcggaatatgctgcgaaagaaaaagtcaatgactatttaatcaagatcatcagcggtgtcttgaaaatccaagctcataaaataaatgcgaaagactcttttgagaagttcggaatcaactcacttatgatcatgtcacttattgcaaagcttgaagatactttcggggatcttccgaaaacaatcttttttgaatatcagaacattgaagagctttcaaacttcttcctaacatcttttaaagaaaaagtgcttaaggccgcaggggcagctccggtaacaagagtacagaagaaaagagaaaatccgagtaaaaaacagcaccggcagcagaaggatacacctgcaccgagcatggatcagccgggggaggatattgccattatcggtgtgagcggaagatatccgaattccgatactcttgaggagttctgggaaaacattgccggagggaaaaactgtattattgaaatccccgaggaacgttgggatttcagatcgaattacagtcccgacagaatggagaaggggaaaatcaacagtaagtggggcggttttatcagcggtgttgatcaattcgatccgctgtttttccacatttctcataaagaagctgagctgatggaccctcaggagcgaatttttctcgaaacctcctggcatacgtttgaagattcaggatatacaaaagagaagcttaacggtatgaaagccggtgtatttgtcggagccatgtacggacaatatcaattattcggcgcagaagaaactgcgcggggcaatccgattgcgctcagttccttcttttcatctattgccaacagggtttcgtacttttttaatctctccggcccgagcattgcactggatacgatgtgttcatcatcgctgacggccattcacttggcatgtgagagcattaaaagaggggaaagtgaaattgcgcttgcaggcggcgttaatgtatccatacaccccagcaaatacctttggctgagtcaaggtaattttgtttccaccgaaggattgtgcagaagtttcggagagggcggagacggctatgtcccgggagaaggttcgggagccgttctgttgaaacctctggaaaaagcaattgctgatcaggatcatatatacggagtgattaaaggaacatctgtaaatcatggcggaaaaaccaatggatttacggttccgaatccgaatgcacaagctgagctgattgctgaaaatttcaagaaatcgggcatcagtccgcgatccgtcagctacttggaagcacacggaacgggtacctcgctcggagatccgattgagatcgcaggattgacaaaagcttttgagaaatttacggatgataaacaattttgtgccataggttcagtgaagtctaatatcggacatttggagtctgccgcaggtatagcagcccttacaaaagttcttttacaatttaagcatcagaagttggcgccatccattcactcggaacagctgaaccaaaatatccgatttgaaaagacgcctttttacgttcagcagaaagaagaagagtggcggaaagaatcaggcgcctctaacaggagagcagcaatcagttcgttcggagcgggaggagcaaatgcccatgtcattgtggaggaatatcaaaaccatgcggacacacaaacaataagcggtccgtttgccgcagttctttctgccaaaaatgaagacagactgaaagaatacgcccggcgccttctgcaattcacagagcgggagacaacagcctcggcagctgatatcgcttttacattgcagacatgcagggagcctatggaagacagacttgctgttgtagcttccgatttgccggaacttaaggagaagctgagaactttctgtactgaaggaacaattggagagggcgtatacaaaggcaatgttacaaaagattttgataaagtctttatctttcatgatcaaaagatgaaagataaattcctcgaagtgatgatggagacaaaggacttgaatcttctagcaaaattatggtctttcggggctgatattcaatggagagagttatatgaagagtataccccgcaaaaggtcaagcttcctttatatccatttgctgaggagtcttactgggtgcctcgaaatcaaagcgcaatatttccggaaatattgccgcagcagtcttcactgcacccgcttctggattcgaatgaatctactctggaacagcagttttttaaaacgacattaagagaaaaagagatttggttaaaagaccacatcgtaaaaaacaagagcattctcccggcagctgcttttcttgaaatggcatgcgcagcgggaacgcggtcatatcgaaagaaagaggtcactcgtttaaaaaacgtgatctttgcaagaccggccatgcttttgcaagagagtctgaccatttacactcacatttccgtaaaagacggcaaaatattatttaatatgtcatctgacgaggatgctgctgtaaggactggatttgtgacgggggaattagattatgatcatcattacggtgatgatgatatagagaatatcgacagacaagagatgataaacagaagtgcttttgtccgtgaacaagatgaatgttacaagtattttcgggaaaacgggttcctgtatgggcgcgcttttcagccgattcaacgtttatggggcggaaaaacagaagcggttgcacacttattgctgccaaaagaagccgcatatgctcttgaaaattatacattgcatccgtctttaattgatggggctctgcaatctttgttcgggattacggacggaagagaagaggcatctgtttatgttcctttttcaataggagagattacgattcggaaaaaagtttcagcagaatgctgggcatatgcgcgtaaaacaggccaaaaaggtcaatccgagcttatttacgatattcagctgcttaatgaacaaggagaaagacttgcaggtttgaaggatgtaaccattcgtaaaaaagaaacgttttccgcggaggcacagactcgtgcaacagcggattccaatggaaagaacgagagagtaaaagagcttctcagacaattaaaagcgggcgaactgactgccgaagaagcagattatgcgctggagcatatgcaggattagtttatcattttgcggcagtgccatttgtaaaggggatgaagatttttatgaaagaagcccgtcatattagaaaaaaagtactttctgacatagaaagcggcatcatttctttggaagaaggagtaaagcggatacagcagcttggttctcattccgcagggggtaacggacaggcgatatattatcagacggtctggcagcggacagatctcagcatacatgtaaaaggcggccggcgtgagggcagccttttattatttgataaaaatgaagatgtgagtaaagaacttgctgcattgcatgatacaagggttattttggttaagccggggaaagagtttcgaaaaaccggggacggtgtatttgaaatcgacccccgctctgaaaaagattacataaacctgttaggatggcttatagaagaagagaagtcagatatacgggaagcggtgcatttatggtcagacatgccgtttgaaaaaacagagagagcaattcgtgaacaatgcgacagcggagtctattctttgtttttattacaacaggcgctcttcaaaaataactgccgcaaaccgatcaagctgttatatggatatttttcgcatctttccggagaacagcctctttacgcggcggcaagcggatttttgcggacattacagctggaaaatccgttaatctcagcaaaaagcattgaaatggagcagtcaatagcagccgttcacgcagctgatatcatacgcaatgagctgagtgatttccagccttcagatgtagagatccgttataaagacatgcagcgttatgtcaaacagctcaaaacgtatgaacccgaaaaaaattccggaagcggagctgtgccgctgagagaaaatggagtatatattatcgcgggcggcgcgggcggattaggatttacctttgcagaatatttggcttttcaaacaaaatgctgccttgttttaacaggtagatctccgctttcagatcatataagaaaacagctgaggcgattggaggatgccggttcttcagctgtttatgttcaggctgatattaccaataaggaagaagccgaatatgtagtcaaaaaagccaaaacttcttatggaaaagtaaacggggtcattcagggcgcgggaatcatccgggattctttccttcttaacaagtcacgagaggaattcgatcaggtaatcagaccgaaagtattgggtacgatgtggctgaatgatgctgttgagaaagaaaatcctgactttttcatttgcttctcctctacttccgcagtgttgggaaatgtcgggcaatctgattacgcgttcggaaacagttatatggatcattttatgaatatgcgttctgcccagcattctgatacgatttctctctctctgaactggccgctgtggaaagaagtcggcatgcaagtggatgagcgaacggtagagacaatgaaaaaggcgggtttttatcctttagaaaaagaagaaggtaaaaaagcgtttgccgtcgcattgtcctccggtttttcgcaattcactgtattttacggagatgagcaaattgacaatcatgttcatcaattatatgaacgaaaagacaatattcaggcagatgaaggaacagggagaaatatcgaatcatttgattcagagaaactgacagctgaaacatctgattttatcataaaaataattgctgcagaattcaggatgcctgcggacaaaatagatgcagaagaggcattggaaaaatacggacttgattccgttatgattatcaatatgacgaatgagcttgaaaaacatttcggcgcgctctcaaaaacgctgttattcgaatatcagactgcggcagaattgtcacagtatttcgttgaggagcacagggatactcttcttcataaactccggttaggagaaaacgggagcggcactccatctcagaagaaaaaagataataaacagacagccgatgttaacgggaaacagaaaatccagatgaaaaatcaggtgcagcaggagaagtatcatgacaatgatatcgctattatcggtatcagcggacgttacccgatggcaaatgatcttgatactctgtgggaaaacttattgaacggtaaagactgtataactgagatacctgaggatcggtgggattcgaggctgcactatcagcctgcggcgggcgacgaagtaaaaaaccaaagcaaatggggggatttattgacgatgtgtatcattttgatccgttgttctttaatatttctcctgccgaagctgaattaattgatccgcaggagagactgtttttagagacggtttggcacaccatagaagatgccgggtacgcaaagaaaacgcttgaaagaaaaaacgtcggtgtttttgcaggggttatgtacggccaatatcagctgtacagcgttggtcacgaagcggccgtttcttcctcatttgcatcaatcgcaaaccgggtatcctacttctttaatttcagcgggccaagtattgctttggacacgatgtgttcctcatcattaacggctgttcattttgcctgtgaaagtttaatcaggaatgaatgtgaaattgcaattgcaggaggcgtcaatttatccattcatcctcataaatatgaactcctgactcaaggaggatttttatccagtgatggccggtgcagaagcttcggttcaggaggagacggctatgtgccgggagaagggacaggtgccgtgctgctgaaacccgtaaaaaaggctattgccgacggtgatcagatttattcagttattaaggcaacagcgatcaaccacggtgctaagacgaatggatataccgtgccgaatccaaaagctcaaagtgaggtcattacgagagccttaaaaaaaggatgtattgatcccaaaagcatcagctatatagaagctcacggaacaggcaccgcgttaggagatccgattgaaatcaccggcctgaccaaagcattttcaggtgccgaacgcgataagaagacatgcgcgatcgggtcggttaaatcaaatatcggacatcttgaggctgctgcaggcatagcgggcattacgaaagttattcttcaaatgaaacataaaacgattgttccgtcactgactcattctgctgaattgaatgagaatataccgtttcaaaaaacacctttttatgtaccggacagagccgaaaaatgggagtcatccgttcccaggcgtgccggaatcagttctttcggggcaggaggagctaatgcccatgttattttagaagaatttgcggatgaagctatctctcctctcgcggctgaagaacctgaacagcttttatttgttttttctgcaaaaaatgccgacaggctggcagaatatgcaaaacgcgcaaaagaacaaatagcagccagagattattcattagaaacacttagaaatacagcatttactttacaaaccgggagagaagaaatgccgcacagattggctgttatcgcctccacaagagatgaattgcttaaagggctgacagactatactctcggaaatgcgagggatcatatttttacaagcggcaaagacacaacagaagctcaaaggacgaacaaagctgaaattgaagaatcagccgcaaacagggatcttgtgaagattgctgaatactgggttggcggtaatggagtagattggctgtcactttataaagatgtcactttgagacgggtatcagcaccgggatatccatttgccaaagagctatgcagaatagatgcgcaaaatacgggaagccgccggatgaacgtaaataacgatctgcatccttacatttcatgcaatatatctgattttaaagcccagaagtttcttatcaatgtaagcgataccggtttgtatataaaaacaaagtatcaagacaaggaaatgtttccgtttctcagccagattgaaatggcgagagctgccggagcgatggcttcagggaatccgattattaaattaactgagctctcctttagagaaccgatgttacaaagcggaagcaatgagcagatccggattgtattaaccccggataatcagggtgcatcgtattctatagaaaaacagagcgacttatccatttattcctcagggcggctcgaattagaaggcggggcgtacgagaacggaaatattcatcttgagccgttcctgtctcagggcgcagaccgtataccgtacgaagcgttttatcagcggcttgccgaattcggatacagctgcagtgacagtctgaaagccgcagagcactgcgtcagcaggaacggacaggtgcttttaaagataaaagcaaaggccgggccgaaagggtgcataatcaaaccggaagtgattgagagcgcatatcaagccgtcgtataccttgcgggggaaaatgccggagagaccccggaaaatattaaagaatgtacgatttttgatcatgagactgaacccgtttatgtatatgcagaacaaactgaagaaagcgattcggcttatgatgtgtatgtattagacaatgccggcgggattttgatggaactgagcgggctggtttttggcgaaaagcctaataaaaatgtacgtttttatgagcatgagtgggatcaaaaaaaccctctgattgaaatgaaagatagggagccaaaaacaattctggtctttgcaaaagatgaagcgttggctgaagctctgaaaaatcaatcagacagccgtgtcattctcgtcacgccggatcagcggcagaccgatcaaaatctgctgacattctgtataaacccggaagtgacgtcagattatattcgtttattcgaagaattggagaaaaaagggttttctcctgatgtcatcttgcacacgggagaaacattttacgcgggtgaccgccttctcagcggcctggaatcaattttttatttattaaaagccctgagcgcccgcagtgacgcctctctttatcttcattctctgcttcttgttcactcttttaaaaaaggcatgaatgatccgtatacgggcgctcttgcaggctgtttaaaaacggcaaatatgttggtgccatccgcagagaatgtgaagtcaatcggtttttcagaacgtatatcaattgaaaaaatggctgaattttgtcttaacgaaatggtttcaggcgtggaacggcaggcggaagaagttaaatatataaatgacaagaggtatgttaagacattaaaggagtatgtattcaatcatacagagcactctcatcagctgaaacagaaagggatttacctcataacgggcggtttgggcggtctgggcctgatttttgcaaaatatttagcctctcagtatcaagcaaaattagtattgacgggaagatcaccgttaacagctgataaacgacataacattgaccggctgcaggcgcttggaggagacgcggtatattatcaagctgatgccgcagatcaaaagacgatgggatgggtcatagaagaaacgaaacggacttggggatccattcaaggcgttattcattcagctggtcatgccgatgatcggttatttacagagatgaatctgactgattttacggaaggcatgactgctaaaattgaaggaacggtatgcttagatgaattaacgaaagatgagccgcttgatttctttatcgtattttcttctatttcttcggtcttcggagattttggacaggttaactatgcgttgggcaattattttcaagatcaatatataaattggagatccgaacagagccgcaggcaagagagacaaggcaagagcatttcgattaactggccgttgtggcgtaaaggcggaatgcatttaaacaaagaagctgaagacgcatatctttccgcatccgggtttgattatttggaaacggaagaagggatagcggcttttgagacaattttggcaagtgactgtccgcaaatttcggttgttaccggggatgccggaacaacaccagcaaaaaaagatctgccgcatcaaaaagtaaatacgcttccggttcgtcaagaggaaagttcttatagaggaccgggttctgcagacaatgtccttgaagaactgaaacaaatggtgtcggaattattgaaaattaacattgaacagctggatacggcagagaatttcggcaatctcggctttgattctatcagtttgaaaacattagctgtcagactgaataaaaaatacaagcttaagctgacacctgccgttttctttacttacagccatataaagtctctttcagaattcctaaacagtgaactgcgtactgttgcaaaagggaatacaggtgcagaaaaaaatatttctgaaaaaaggaaagtgcacgccgggaaaaccgcagggaaaaccgtgaagccgccgcgaagttttccgtttgaaaaaaagacagcaagacaggctgaccatcatccggagaagcagccggttgccattatcgggatgagttgtgtttttccgggagcaaaaaatgcagatgagttttggatcaatttaatcaatgaaaaagattcgattcaggaaattcccccggatcgatgggattggaaaaaatacgccgaaggcaaaggaagcagcgaagtacattcgaaatggggcggatttatcacagatgccgataaatttgatgaggcgtttttcaatattaatccgcgggaagcagaactcatggatcctcagcacagaatttatttgcaggaaacctggaaagcgatagaagatgcgggttacaaagcttcaaagctgtccggcaaacatatcggggtgtttacgggcattcaatttaatgattaccgccagctgctgatgaggcattcggacggggcgcatgcgtttgcgggaaccggaaacagccaggcgctcatcagcaatcgtgtatcccactattttaatttcagaggtccgagtgagtccattgatacagcctgctcaagcagtcttgtagcaatccacagagctgtgcgctcgattcaaaatggcgaaagtgagctggcggtagcaggcggggtttcgctgctcttagatccagtcacgcatatgtataccgataaactcggtattttgtctagggacggccggtgtaagacgtttgataaacttgccgacggttatgtccgcggtgaaggtgcagctgttctgttattgaaaccattgcaagcggcaatgaatgacagagacaatatttacggagtcctgagaggaaccggagaaaatcacggaggaagatctgcttcattgaccgctccgaacccggaagctcaggcagaactaataacgtctgtttacaaaaatgccgatattcctgttgatacgatatcttatattgaagcacacggaaccggaacagaactgggagatccgattgagattgaaggcttgaaaaaagcgtttggatcttttgagccgcatccaggaaagaatcatgaccaatattgcggcatcggttcagtaaaaacgaatatcggtcatttagagcccgcctctggaatgccggggctgattaaagtattactatccatgaagtataaaacattgcctgccacacttcatgttaaggagctgaacccttacattcaattaagcggaacaccgtttcatattgtcaataaaactatgaagtgggccagattaaaagatcgaaaaggaaatgaaattccgcgccgcgccggagtcagttcctttggattcggcggggcaaatgctcatgtcatcgtggaagaatttgaatacggacaagataaagcagtaactgccgagcgggatcaaatcattgttctatcggccaaaacaaaggaaaggctgatggttaaagccaaagagttaacagcgtttttacatgaagaactatcagttcaattcagtcagcaagaggtgcaggaacgtgatgtgcaagaggcggttcgggaagcggcagcgggtatcctgcgtttagataccgcaaatatagatgcaaagacacctctttcggaattcggatttgatccgttggcttattccgaattaatctcttatataaaccaaatgtacggcacagaaatatcactagatatatttcaggaattaatgaccctgagtgagctgtgccgctatatcagcagcgtctggaatcgatcagctgataaaccgtataacggcaattttagagaaaagtccggaatcggtcttgaagaaatagcatatacgctgcaaaccggaagggaaccatttgaatgccgccttgcgatcacttgctcgaataccggagatcttcttgaaaaattaaacggttacattcaggggagcagactgcaaggtgtttatgaaggaaatgtaacggattttgatagtctgtacgctcctttattcggcggccccgaaggtcatgcatatgttcaatcactgattcagcaaaacaagccggccaaactggctcagttgtggacgatcggttgtgaaatcagctgggaagacttgtatgaggaggaactcaaaccggttaaacggcctcttcctctttatcctttcagtaagaacagacattggattcatttaaataaagatgaagcgcagaagattgaggctttctcgaacactgagcttcacaattcaaataaagatacagcagatggagaaatcatgtcgcttcttgaaaaagcacaaacaggtgagatgaatacgaaagagacgtcagagctgatagaggagttgcttttccatgaatgaaaaaacgatgcaaattgagcaaatcgtgaaaaaggtgaaagaaggcagcctgacgcgtgaagaagggctggaattaattaagagtttggggaaaacccatctatatgaaatggtatgggatagacatgaatttaaaggcagtgaaaaattcccgaatacgaaagagccaattttatttttttgcaaagacgacagcatgtataccgtaatgaagagacagcttgaaggctatgaggcgcctttcatttacgtgacttccggcgagcgtttcgaagattgccggaacggtcgttttaaaatgaactttgcaaatgatgaggattatgatgcgctatgcggggttctgcgttctcaaaatataagaccccgccatattattcattttttagctgccgggctcttcaaaaatacagaagatgcaataagaaagcagctcaataaaagtctgttttccttgtttcaaatgtttcaggccttcatggcgaacaaactttgtccgaaagcagaagttttgtttctgtatgaaaatgccgagggcgaggttcagcccatttataacgcggttgaaagttttcttaagaccgtacaggccgaaaatccgaatttcacatgtaaggctgcagagctgaaatcaatgtttgacgagccgtttacaaagcagcatattgcagatgtcatctcttttgaatggaacaatcaatgcaagacggaccactttacctgttatgagccgaggcattattataaaaggcagcttaaaagagtaaaaaaagaagatggggagaaacatagtttcagtgtaaaaaagaacggtgtgtatttaattacgggaggagccggaggcctcgggtatctgtttgcggaatatctggcgaaacaggcggaagtcaagctggtattaaccgggcgttctccggcatcccgtgaaacggcgcaaaaattgagcgcgcttgaaaatctcggtgctgaagccttatatgtcccggcagatatttcaaaggaaaaagaggcggacgcgttaattaagcacattaagcagacattcggagaattaaacggaattttgcacagtgccggacttgttaaggatgcatttatcataaaaaaagcgaaagaaagcatagaagaagttatagcgcctaaagtattcggaaccgtttggctggataaagcagctgaagaagagcctcttgatttcttcgttatgttttcatccctttcggccgttctgcctaatgcgggtcagagcgactacgccttcgctaacggatgtatggacggattcacccagtatcgaagcattaagggacgtcccgggaaaacactttctattaattggcctttatgggatgcggggaatatgacagttggtccggcagagctgcaggctttaagacacacggggctggaacttttatctgcccaagcagggcttgccgcttttcaggacagtatgagccgttctgcttctcagctggctgttatcagcggagacaaagatagaataagtgaattactctcaactgaccataaaaagatagagactgtgcctgaaaacaacagtctgccgcaattaaatgaaaaagatctgaaaaagcaaacgatccgtctattgacagagatcgtcggtgcggaaacgggaagaccggcggacagcattttacccgaggatacatttgaccgttacggaattgattctctaacaattttaggtcttaactcccgtctcgaaaagtattttggaagagtgtctaagactcttttctttgaatacagcagtgttgaagagctgtcagagtattttcttgaacactatcaacatgagttgaagaaggcgtttttaccggcagccgaacagcgaattgatcattcggcgccggcgaaacgggagaagctttccgtttcccgcataccatccgcaccttccgaggaagatattgcaattatcggtatagccggccgctacccgatggcgaaggatgtggaacagttttgggaaaatatttcttccggaaaagattgtataacggaaataccgaaagagcgctgggattttcggaaatattatcacacaggtgacaatgcccgtcatgatagcaaatggggaggttttataaaagacgctgataaattcgatccgctgttcttctcaatttcgcctcgtgatgccgagttaattgatcctcaggaacggttatttttagagacagcatggcacacgtttgaagatgcgggttacacaaagaaaaagttgaaacggcataagacaggggtatttgtcggcgtcacctacagccactatcagttatttgcagccggtgcttcagatgatgagggacgtcaggcgctcttgtcttcttattcgtctatcgcaaaccgggtgtcatatttctttgacctgcacggacccagccttgcaattgatacaatgtgttcttcttcactttctgctgttcattttgcatgtgaaagtttaaaaaggggagaatccaccctcgccatagccggaggagtgaatttatccttacacccggataaatatactttactttcacaaaatcattttgtttcaagcgatgggcgctgcagaagctttggagcgggaggagacggatatgtgccgggagaaggagtcggggccgttcttttgaaatcgctttctgccgcaaaggctgacggggacaggatttacggtgtgattaagggaacatctgtaaatcacggcggaaaaacaaatggatacactgtgccaaatccgggcgagcaggcaaacgtcatcagtgaaactcttgataaggcggggattgatgcagacagcataagttatattgaagcgcatggcacagggacatctttgggagacccgattgaaatttcaggtttaaccaaagctttgcacagctcgaaaagcgattatcgttgtgcaattggttcggttaagtcaaatatcggacacctagaggccgcggcgggaattgcttctatcacaaaagtgctgatgcaaatgaagtataaacagcttgctccttcccttcattccgataacttaaatcctaatattgattttgaggaaacaccgttttacgtgcagtctgaattgaccgattgggagacgccgcaaaatcaagccagaaggtcgggtatcagttctttcggcgctggaggatctaatgcccacattatcatcgaagagtacaagaatgaagaaaagatggaaacggtacagagcaacaagacgcaaattattctgctttctgccaaaaatgaagaacggctcagactcttgattgatgcatatataaaagaactggagccaaaaacgtcactagctgatgccgcgtacacttcgcagaccgggagaaacgctatggaagagcggctcgctgttgaggttagcagccttgacgatcttcgcgataagctgacgatgtatttgcggtcagatcataagttaaacggtttatataggggaaacgcccgccgaggcgccggtcaaaagaatgccctgtcagccgctcactttgaaaatgcaagagatatggccattcactgggtgaacggaggagacgttgaatgggaagagatgtacactgcggaattaccgaagcttatttctcttcctgcatacccttttgaacggaacagatattgggtgcctgccgcaaaagcagcacagaaacagaaaacaggtgtaccgcagagtctgccccatgcaccgactgacttatcatttgatgtattaaaaaaatcgtggaaaaaacaaaaggctgcgccttccgcttttacgaaaggacaggtgatgatcctggctaatagtgaaagtgagcggcttgcattcgaattgtttgattcagatcctctgattgaacccgctgtcatttgcgcagataactgggatcattcggatggggaagccaaaaaaacggctctagcagtcatagaagaaaatccggaaatcatcggcatgattgacctgtcagatttgcggagtaatcaaaacggggcacgcaccggcacaatcgggaagctgacactgctgcaggaaatcataaagacacgtaaaaagcttttcgttttacatgtgacaagagggctgcagacacttctgaatgacaagccgtcgttagccggagccgaaacagccggactatataaaatgctgagcgcggagtatcaaaagataaaatcaaaaacaatagatgtagacgggcatgtcgggactgcggcggaactgagacaggtaatcacagatgaagcttgcgctgacgggctgtatagtgaaatctgctaccggaacggtgatcgttatattccatacgtcgagaaattaaatgcggcggaaataaaccggaacctatccggtctgccggtatgccgtacggatcaaaccttggttattacagggggaacaagagggatcggagcagaacttgccagacattatgccggcaagggagtcaaaaaacttgtgctgatgggagtaaccgaccttccggaatctgataaaatagccggcatgttagaagacaccgatgaaaagtcacctctttattcgaaattacaactgctgcatgagttggatcaaaagggagttcaggtggaagtgtattccgggccgctcacggaaaaagaaaaattacatcgcttcttttcagaggtgcgaatgaagttcggcaaaatcggcggggtgattcattgcgctggtgcagccaatcattcgaatccggcttttattcataaatctgatcaagaaataagagaagtatttgagccaaaggtgcaggggatgcaagtacttcatgacgtttttattgatgacgaacttgatttcttcattttgttttcatctgttgcgagcgcttttcctttattaggcgccggaacaagtgactatgccgcggctaacgcttttatggattactttgcggcgtatcagcatgcagccggcaaaacatattatcaatcaattaactggccgagctggaaggacattgggatgggcgaggtgacaagtccatcatatcaggcactcggtttactttcacactcaacagaaacaggtatttccatgctggatgaaatcatgacgataaacggatatccatgccttataccggcaaagacacatccggagaaattcaagctgaagcagctgcttcagacaagaattcaagcggctaaaaataacccggatgctgaggaaaaagtgatctctggtcatggtgacaatgaagctatgatcaggaagttaatggagattttttccgcggagctgaaaataccttacgggaatttagatcaggatacgtcttttgcggattacggagttgattcaatcttactggttcagcttgtcaaaaaagcggaagatgcatttcaaataaaaattgaaccttcggcttttctggagtatccgagtttttcacaactgggcgtctatttgaacgagttatttgcaagtgaggggatcagtcctcaaattgattcagaaaatattgaggttcggaataaagagcaacatataaatcaaaatgcttccgaagtacgggacagcggatctcaaatgcaaccaaccagtctgaatcaaatcgctattatcggaatgggctgtgagtttccggatgctccggacacagaaacattctggagaaatttgaagaaaggacaacatagtgtccgtgaagtcccggcgtcgcgatgggatatttcttcatactactctgacacctatgaaaaaggaaaaagtatcagtaagtggggcggatttcttcaagatattgagtctttcgatcccgcgttttttaatatgaacaaaagtgaggcatcagagcttgatccgttaatcaaaaaatgccttgaggtcagcgtccagacattgagagacggcggctatacaaaggaagaagtatcaaacaaagaagtcggcgttttcatcggttcgcgcaccgggacgtttatgtccaaaataggttccccttcaaaaaatacgatcgtgggtataggacaaaatttcataggcgcgcatatctcacacttttttaatctgaaaggaccgaatctggttgtagacacggcttgttcttcttcattggtcagcgtccatctcgcttgtcaaagcctgatgtcaaaagagtcagatatggcaattgcgggcggggttgacattttgctggatcaaaagccttacgtcatgctgagtgaggctcgggcgctttcacctgaaggaaaatgtcatacatttgatgagaaggcagatggatttgtaccgggagaaggatgcggcgcagtccttttgaaaagacttgatgacgcccttgccgaaggtgacagaatttacgcggtaattgactcctccgcggttaataatgacggacagacaatggggatgacaacacctaatccgaaagcgcaaagcgcagtgataaaaaaagccctgaaaaaggcggaatagatgcagatactctcagttatgtcgaaacgcatggcaccggtacgatgataggagatccgattgaattaaaagcgctgactgaagtgttccgggaggttacggaagaaacgcaattttgcggagtaggcagcgtaaaaacgaatttcggacatttaatgagcgcagcggggatagcgagtattataaaggttgccttatccataaaaaatcagatgctcccgccgacactacattgtaaaacgccaaatccgcgttttaaatttgatcagtcgcctttctttccgaacacgtctttaaaagaatggcgtcccagaaaagggattttgagagccggaatcagttcttttggattcgggggcacgaacgcacatatgatattgagcgacagccatctcacgttaggatatggagagacaaaaagacacccgctttctccggttatattcaataaggaacaatgctggatcgacaatggagaagctccagaaaaggaagagtcagaattgctgattcctttacttgatttcaaagaattataaagaaaagaaaaggaatgagacaggtggccagtaatcaaaactatcagttcacattaacaattaaacatacggactatattgtcagggatcaccgggtgcatggcacccggattatacccggtgtcacatttttagatatgatataccgtatggcgctgagtaaaggtttgcctattgaagaactcgagtgtcagaatattttgtatttggaacctgtagcaacatcggacacctttgacagagaaatccgcatccgttttcagggattggaacagggatgggaaatccaggcgaagagcagaaaggtaaaagatgaccggattctggatgaaagctgggatgagaatatgaactgcaggctcatgcagaaattcccggaaagcatgagttcaattcatatcgatgaaatcaaacatgcctccgtccgtgaagccgatatggagatatgctatgactatttaaaaaaggttgatatagagcattttgaatttatgaagagtctggggaaggtttatgcgtctgatcattctgtacttgcagagttgtcgctcagccaaattgccaaacaatataccggctattttcaattgcatcccacttttcttgatgcgtctaccatcatatcgatcctttatcaggcatgtcccgaatattttacacaaggatctccggcaagccggatgaaaacgtatattcccattcatattgaatctttccgtatgacgaagcgcctggaagacaggtgttatgtgtacatagagaagcaagaccaaaatcatgattcaggggatgtcatccaagtcagttacggtttgtacgatgcacacggggagatgatcgcttattttacacggctgtctgtgaaacatattcgctcaaaagatttaattgaaaatctgaagcagactcgtttagaaactgaagcggcttctcagccaaaagacggcctgatgagaaaagattcaatcatagatcgaagcgaaagcattgagacacaccttaaagaattaatatccggggtttcaaatatagatctgcgtgacataaggacagacattggtttttatgaacaaggcctggattccgcttctttgcttgccattgtcaaagaacttgaaaacaaaacaggggaacagctgtatcctacactcctgtttgagcagaaaacgatccgggaactcgccgcgtatattaaagaaaatcaaaaaatgtccagttatttcttaacgcaaaatcaaccggctgaaaagcctgacatgaaagaaagtaagaacgaaaatctttccgctcttataacagaaggagacattcagcagctgatcgcagacatcaaagggactgcccctgaaacactctctgtggtaaaaggtttttatgaacaaggcctggattccgtcacacttatgcaagccgtaaaggcattggaggagaaaacaggcagggaactgtaccctactttattgtttgagtatccgacgattcaaaaacttgcaaattattttgcggagagcggcgaaaagacttccgttgacaaagacctccctctacatcatggagagaatcatacggctctgacctatttaacgccgtattggagacaaaaggctgccgcttgggacccgcattgcggaaataaaaagaaaagaacatgtctgctgtttcaatatgacagagagctttttcattttatgcgggaaaatgctgaaaatggattcgaaaatacacagatcattctcgttttatcagggaatcgtttctcctatcacggagacggaatttatgagatagatcacagggaggaagcccactttgacaggcttgcagctgatctgaaaaaaagggggcaaatgcccgacaccgtggtgtacgggtggccggaaggatcatttgccggcccggaaaaaataagtgaacagctttctaaaggggcttacccgctattctttttcagccgggcattgatgcgcagcaaggcggaaaaaaaggttgtatcgcttttcctttatccggcggaccataaaaatgatcagccgctttacgcttcagtccatggcgcagggcagtctattttgcttgagaacccgaaactggcccttaagacaatcgggatatcagtttcagacaagacatcgttgccggctcttacagctgaaatcatcagatgcgaatcaactgaagcgcatccgggagaaaccgatctttattatgaaggaaatgtgcgctgggtccgtgccttacgggaagcagaaccggctcaaaactcagatttctcctttaaagaaaacggagtatacatgattacaggaggggccggcggcttaggccttatatttgcagaacatatcgcagcgcaaacgaaagccaatattattttagcgggccgttctgaactgacggaagacaaaaagaacaaaatcagccgaatgaaagcaggcggttcttccgttcaatatataagaggagatttttcagatagccgcgatgcagagcgaatcataaaaactattaaaaggaaattcggagaaatcaacggtgtgatacacagtgccggtgtgacgcacgacgctttattgattcaaaaatcaaaagatgaaattcaggaagtgatcgctccgaaaataaatgggacggtcttattggacagcttgctgcaaaccgaacctttggacttctttgtgatgttttcatcaagcagctcgatgtacgggaatatcggacagacggattatgcattggctaaccggttcatcgatctttttgctgagtggcgtgaaggaatgaggcggaaaaaagaacgctccggcgtctcagtagccatcggctggcccctatgggaagacggcggcatgaaagtggataaacaaactgaaaaatggatgaaacaaaaaatcggtatggttccccttagtaaaaccaatgggatcaaagcttttcaagattcactctctatgaacgcatcacagctgatcgtgtttgaaggtgacaaagaaaaattggaatctgcacttcaagataccttcaaggaggatgaaagccgtgagatccaaataaatgaaacagctgatacaaggcatcaagacattgccattatcggtttaagcggaaagtatccgatggctgaagacttacctgaattttgggagaatttaaagagcggaaaagattgtattacagaaatcccgcctgaccgctggaatatagatgatttcttcagcgaagacagagatatgaaagggaagtcttacagcaagtggggaggttttatcagcggagccgatcaatttgatccgcttttctttcatatttccccaagggaagcagaacttatggatccccaggaaagactctttttagaaacggccaaaaattgttttgaagactcagggtacccgagaaacatgctggaaaagatgaaagtcggtgtatttgtcggtgcaatgtggggccaatatcaactatttgaaggagaagaaaatggagcggctttttcgccggcttccgtctattcttcaattgccaatcgggtgtcttattattttcatttaaaaggtccgagtttggctctggatacaatgtgctcttcatcattgacctctattcattacgcatgccaaagcatacattgcggagagagcgatatggcattagccggcggagtgaatttgtcaatacatccgaataaatataagttcctcagcatgggacagtttctatcaagtgacggcagatgccggagttttggaaaagacggaagcggttacgttcccggtgagggagtcggagccgtattgttaaaaccattgaaaaaagcaatagaagatcaagatcaaatatacggcgtgattaagggaagcgccgttaaccatggaggaaagacgagcgggtattccataccgaatccggatgcgcaggcggaggtcatttcagaagcgcttcgtaaagctgacattgatccgaacaccgtcaattatattgaagcgcatggaacagggacatcattaggcgatccgattgaaattcaaggactgaaagattcctatcaattgaaccatccttgcgccatcggttcggtgaaatccaatatcggacatttagaatctgcggcaggaatcgctgcggtaacgaaagtgcttctccaaatgaagaataagcagcttgttccttctctgcattccgatattgttaatccgtttatagattttgatcaggttccttttcaagtgcagcggaaagcggctgaatggaatattccgcaaaacagccatgctgttcatcctttgagagccggggtaagcgcttttggggcaggaggaacaaacgcgcatcttatattggaagcgtatgaaccgccaaaagcatttgatcatcaaagcggccgagtgatctttgttttatcggctcaagacaaacaacggctgataaaatatgcaaaggttatggctgattttctatcagaaaatgaatcgaaggataacaatcataaactgcgtcttcaggatattgcctatacacttcagacgggacgcgatcatatggaagaacggctggcgatagtggcagattccgggcaggtcattgctgaagagctttcagcttatatcaggggtgaaaaaagcagcctgagccataccggtaatacattcgaatcagaagttcacaatgaaatgcctcacgtttgttcagattacgccgaagcagcatccaaatgggtaaatggaagaaagatagattgggagacttttgaggtgaatcggaatgcccgcaggatttctatcccgggacaaccgctgatcaaacagcggtattggatagcggaaaaaggggaagcacttgtttcagcggatgtgagtaagacgggccaccctttcttggggagtaacacgtccgattttcatcagttcagtttcacgaaaaaaatcagccgtaatcatccgttcgcactaagtctgtctgaaggaaacgtgtcctttttcccttatgcatctttggctgaaatggctatcgtcaatgcagcggcggcatttggacaaccagttcaaacattgaccgatttattgtggaccgaaagcatgaacggaatgacagatatacgggaactgatgattacgctgacgcctgagcgtgactttgcgcggtttgacatatatgcaaacacaaaaaatgagaataaagtacgtcttgccagcggaaatgcgcatatggttaagcctgaaagcggtatgcttcctgaagcgcttgatattgctgaagtcaaatcagaaatgactgaacatccggctgaagcgccttttgtcattgaatcagcgaaaaacagttacggaatgctgtcgcttcattcaatgccggatgagctttatgcaaaaagagaaaattttacgatttctcctgaagcgcttgagtccgcgattcaagccagtgcattttttgtcagcggagaaaccttcccggaattgatcggaatgggagcggcggatgtctatcagcctctcgctcaaaatttttatgtttatactcaaaaagtgaaccggcagaacagccgtgatgtaacgtgtcatatgacatttacagatggaaacggaagcattctggcggagtgcagagatgtgagattcagatatggtcatgaaaaagacactgttcagacggacgatgaactcattcgtctcctgcgtcaattggaaaccaatgatattgatcagaaggctgtattgaaacaattaatgggggaagaatgatgaacggaaaacgtgaacaaatcagcgatattcttgatctgattcaaacaggacaaatgtcggctgacgaaggctatgcccgtgtaacatccattcagaatcaaaaatcacgggcatcgaaccatcctcttttatattacaagccggaatggacagaatcgttcattccgagtacgaagagcgtacccttgacgggattgctcctgatttttgcagaaaatgaacggcaaatacaagaattgagcggtttgtttaaggactgcactctcttgtttgtcatccgcggagaagaatttgctgttttacatgatgatacgatttgtatgaaccacgtgaaaaaagacgattatctaaagctgttccgatacattcatgatcattatcagccgcccgaaaagattcttcacttgtggtctgattctcaggctgacatgagtaagggaggtatacagaaacaattggaaaacggattgttttctcttctgtatattacacaggcgctgattgaattaaaatggaaaaagataataaaactgacgcatatttttcaaactcagaataaagaacaactgccgctgcatcatgctctcggcggattggtgaaaaccgttcaccaggaacaccccaattttcactatcagattatcaatatcactcaatcagagggtgcgggagccgctcttccagcaatagctgatatatatcagagagagtgtgacgaaaaacgggatatccattttgaagtgcgctatgaaaacggcagacgttttacgaaaagctataataaagccggcttattcgatttaacccagccgctgaaacatcatgaaaattatctgattacaggaggcctgggcggtctcggttatatactggcaaaacatctgtcggaaaaatggaaagcgaatctcatattgacagggcgctctgatttaactgaagagcagaaaaaaaagatcgaatatttaagaagttcaggttcaacagttgaatatatccgatctgatgtttcaaaacaaagtgatgctgaacggatgtttgcttttgcaaaagagcagttcggcaccttacatggagtatttcacagtgccggcgtactccgtgactcttttatcttaagaaagacaaaagaagaaatcgatcaagtcacaagttcgaaagtttatggcgcgctctggctggcggaagaaatcaaaaaaatgaaagttgaattacttgtcttgttttcatccacatcggcagtcttcggatcagccggccaatgtgactatgctttcgccaatgcctttttggatcagtatgcagcagttatgaccgcaaaagagtctgccgaaagggtggtgtcagtcaattggccgctatggacttccggcgggatgaatattgacgatgaaggaatatcctacatgaaacaggaactcggccttgacccgctagatgacggtgacggaatacaggctctggagaacagcttgtgtcaatcatctgaacagctgatcgccctgaaaggccgaaaagaaaagattgaggatgtgctgaagcgtgccggcacaatcagcttacattcagaccggcaggaagatgccgatttacaaagcgatgaattaagacaaaatatcatcagttatctaaaaaatataatgtcagaggaattgaaattaccggtctcactcatagatgaaaaacaatacctggagaaatacggcattgattcagtgatgatcatgcgcctgaccaaaaagctggagcaaagtatcggcagattgtcgaaaacattattttttgaatatcattccatatcgcagttagccgaatatttcctgagtcatcacagcgaacgaatgatgaaactgctgaacccggccggcaaatctgaacttgtttcatatcaaaaaaagcaaaaaagaaaaccagtggaaacaaaagcgccggcacgctctgaaggagaaggttcaaaagagcacattgcggccgatcccctttctgctgatatagccattatcggtgtcagcggcagatatccgggtgcggaaaacatcagagagttccagaatgtgctgatgaatggacgggattgcgtaagcgaaattcctgatgaccggaaggaaatgctcgagggaagctgctataagtggggaggttttctgaaaaatccagaccggtttgatcctttatttttccggatatcaccgaaagaagctgcttttcttgatcctcaggaacgtctctttttagagacagtgtacaataccatagaggatgcgggttataaaccttcagatctgacccgcaaaaaggtcggagtatttgcaggcgtcacatatggaagctatcaatttttcggcgttgaagaatcacttaaaggaaatgaactggccgtcgggtctccattttctgcaatagcaaacagaatatcgtatttctttaattttaaggggccgagtatggcggtggatacaatgtgttcatcctctcttaacgccattcacttagcctgtgaaagtatacgaagaggagaaagcacacttgctgttgcgggcggagtcaatcttacacttcatccgaataaatatacattattaaatcaaagccgcttctttgcaagtgatggccgatgccgtacattcggcgagggcggtgacggttatgtaccgggagaaggagtgggctccgtacttttaaagccggcggcggaagcggtaagggacggagatcatatttatgcgctgattaaagcgacagcggtcaatcacggagggagaacaaacggttttacggttcctaatccaaatggtcagtctgaactgatacaggacgcgcttcagaaagcttgtattgaccctcgtacaattagttatattgaagctcacggaacgggaactgctctgggagacccgattgagatcaccggattaacaaaagcgtttcgggaatttacggagcacactcaatattgttcaatcggttctgtcaaatcaaatatcggtcatcttgaggccgcagcgggaattgccggtttgacaaaggttcttttgcaaatgaaactgaaaaaactgtttccttccatacatgcggagacgttgaatccaaatattgattttaaagcatctcccttttatgtacagcggtcattgcaagactggaagaaaccgaaactgcaggaaaacggaaaaacagtaactgttccgagaagagcgggaatcagctcattcggagcgggaggaacgaatgttcatatcattatagaagaatatgaagaaacaaacgtctcaacagaacatgttgagaacgaaccgcatattgtcctgttatctgccaaagacaatgaacgtcttcttgagtatgccgaaaacatgaaagattttattcagcgttcactaagtcctgaagtaaaggataaacagactgatatgaaagaaaaggtgaatgaagtactcaaaccgtttgtttcggaattgcttcatatccatccggaagaaattaatatttctgatcacctgagtgaatttggcgtagggcctttggaattaagccggatggcggattttattaacgaaatgtttcatattgaactcacgatgtatgaattaacggattgcccctccattcaagcggttactgaatacttactgaaggaatatgccggagcgataagagacatgttcccgaatgaagtgatggaaggcggccaatcggaaagcgtcgttttacgggatctggcatacactacacaatcgggcagagaagcgatggaggccagagcggcgattaccggtacctctcttaaagaaatgaaagataaattatctcagttttgccgcggtgacaagcaagttccaggcgtatatgttaatcagcaatcagatgcatttgctgaaaaaatgaaggcgttaacggaaggcagagcaggcgaattgtttgtaaagaccattattgagaacggtgaagcggaaaagctggctcaattatgggtttggggggcggatatcgactggaaatccgttcatcaacatttacagcagccgggtaaacggatctcaattccgacttatccgtttgcaaaagaacgttattgggttccgtccaggactgagaggacagagatccctcagcattcttctcaacatcacttgcaaaaaaaatggagggagaatccgtttgtaaatccatccgaaacaaaagagtacggactgacagtcgcatttgtgaatcaagacacagaatcaattgcccgcaccatttgtccggatatagatcaggagaatctgattgtcataaaacatcactcttcatatataaaacactctgatcaaatgtttgagtgttctttattagatgaaaaccacgcatacgacgttatctgtgagatcttctcgggcggtgagcggcaggtcgaaaatatatttgatttctcagatatcggaaaccagagtgaaaatcagaacggcatcccatatggtaaattcttatttatacaagaaataattaagcggagaaaaaaggaaacaccattatccattttacaactaaccaatggcttgcaggtatttaaagcggaaaaaccaaagctgacgggtgcagaatcagctgcttttctgaaagccctttctgcggaatacggctttgttcatgtgaaaacaatagatatagacagcatgaaagaaacgcataagctgaaacaaatctttgagattgaaagggcgcaatgtacaggagagaatgaagtatgctaccgcagcggcgtcagatatgttccgtattttgaagaagaaagaatcgataccggcggcggtcctgtttcatttcctgcggataaagccatcgtcattaccggcgggacagggggcattggcagagcaatagctgaagatttggtgaaacggggagtgaaaaaactcgtgctgacgggtacgcgtccattacctttgcgaagtgaatgggatcatttgctgaaagagggcagacaggacgaaaagacagtcagcaatataaaactgtttcaaagttttgaagaaaaaggtgtcgactatctgtattacagcggttctctcacaaatgaagagaagcttcgttcattctttcaccaagtaagccttgaatttaaagatattagcggtgtcatacactgtgccggactgcacagcggcggaaatccggcctttattcataaaagaatgagtgaatttaagacggtgtacgggccgaaagtcactggacttcagaatttggagcggatttttaataataggccgctggatttctttattctgttttcatcaattgcagcacagtcacccaaactgtcgaaaggaatgactgattacgcgtctgcaaatgcatatatggactatttcgcggcttatcattttcaaaaggggagaacgtatttcacgtccatcaattggccgagctggaaagaagtcggaatgggtactgtgacgagtcctttatatgatgaattgggattggactctctatccacgcgggaaggactggcgattttgtatcatgcactggagaaaaaatcggccaatatcattcctatcgtgaaaaaaggaacagtgtttcatgcagacagtctcctgaacatcaataaaaccggcaagacttcatttccggcccgaagacaggagactcccggcacttttgatcattcagaagggcttgtcagtgaactttctgccgtatttgccgaggaattgagcataccccttgaaaagcttaacccaaatacggattttcaggaatacggtgtggattctatacttcttgtcagcattatacatcgtatagaagcaatgattcagaaaaaaatcgaccctactgtgcttcttgaacacaacacgattcatggtctcgcggaatatatcggtaagacggcgccgccgttgaaaaaacaaatcgaacagactgattctcaaagcagcaatcagcatgatatgcagtctgtgacgagccgaaatacagaaccgcagacggcttccactgcaaagatagctgttatcggaatcggatgtaagtttccgggcgcggctgataaagaggaattttgggacaatctgagaaaagggaagaatcatattaaagaagtacctgattcccggtggaatatagaagaacattactctccggtgcagcaaaagggaaaaagcatcagcaaatggggaggatttattaatggaatcggcagcttcgatccggagtatttccgtatggaagaggagaaagccatccaaacggatccgctgataagacatttcttagaaacgagtgtacagactgtacgtgatgccggttatgaagaaacagaattatcgggaaaaaaagtcggcgtatttgtcggttccagaatgggcggctacggtcacaaactgccgaaagaaagcagcagccacatcgtcgggcttagtcaaaactttattgcttcacatgtgtcgcatttctttaattttcacggtccaagcatggtgtctgataccgcttgttcttcttcattagtcagcattcatttagcctgccaaagcataaaaaacggtgattcagaaatggcgctggcaggaggggcggatctgcttttggatgaaattccttacctgatgttaacagaaggaggagctctttcgccggacggtcagtgttttacttttgatgaaagggcaaacggctttgtacccggagagggttttggcgctgttcttttaaaaccgctggagaaagcaaaagctgacggaaatcggatatacggtatcattgaagcatcagctattaataacgacggtgcgacaatggggattacgactccgaatcctaagcttcaagagcaggttattcaagatgcatttgaaagagccgatatcactcccggatcagtcagctacgtcgaaactcacggcacaggcacgatgattggagatccgattgagcttcaggctctgacaaaagtattccgaagagacacaaacaaaacgcaattttgcggagtaggaagtgtaaaaaccaatatcggacacttattaagcgccgccggagcggcaagtttcattaaagtgattttatcaatatggcataaggaaattccgcctacattgaattgtgaaacgccaaatccccgctttgaatttgaaaagtcgcctttttatccgaatacagaactgagaagctggaaggatggaaaacggagggcgggcatcagcgctttcggtttcggcggaacaaacgcccaccttttggtaagcggcctggatgattcatatcattccgtcagaactccgctgccgcctgccgagtttgtcagaaaagagtactggccggattcaaatcgaaaaaaacaaatcaaacagaataaaaaacggcttcttgaaattattgatgaaacagagtagcacctgctctgtttctttactttgtaaaagaagaaaggttgtcgagttgcatgaggttcagcgtattagtcaaacatgacgattatattgtttcagaccatgtccttcatcaagtgcgtacgatacccggcgtaacgtatctggatttaataacacgatttttagctgagaaagggatatcaccccgaagttttgaaatcaaacatgttttattccgtgaacctgttgcgacgtcagtccattttgataaaaaagtcaccttccagtttacggaacaagaaaacggctggcttgttgaaacaacaagcaggaaatgggtcgctgaaaaggcggaaggtgaagcgtcagtcaacttgcaggcggaaatcataagaaaaaatgcgatagacgaaaagacaatttcaatcgaagcattaaagaaaggggccgtccggacttcgaatgctgaagccgcctatcgtaatttgcgcaggggcggcctgattcataaagattttatgaaattggaaggtacggtatatgaaggtgaaaattatattctgggagaggtcagtttaagcggactttcaaaagaatatacagatgacttttacatgcaccccgcatttttggatggatctctcagcctgttgggagtccttacatcagacttgccggatgaaggaacaaatgcgtttatccctatatatattgagacattccgggcactgcataaaacaaccgggtcttgttttgtgtatattgataaaaacagtataacgcagccgccttctaaagacattttatatgcggacatagaagtatacaggcctgatggagagcttgctttttattatgagcgattcggtgtgaaaagagtcagaaatgaaaaatcaatacaaaggctggagcattcccaaaaagctaaagacgtcggcagcgtaacgaacaataaagaaatgatcagaaataatttaatccaagagatagccggcatgattgaaaagcctgctgaaacggtgaagaatgatatttccttttacgagatgggcttggattctaaacagttattagacttatctaaaaaattagaactgttgttaggttcaaagctgtacccgactttattatttgattactccacaatcggtgaattgacggaatatctgcaggagaaatacggagctcgcgttacagactctatctctgatacagttcagcaccaagacagtcaaaaaacattaacagatgagctgtcatccattattggagatgtgacaaacacgccgccaaataaagcggacaaacaccaatctttttacgaactgggtcttgactcaaaacagctgctgcatatatcgaaaatgctcgaggaaagattggatacacaattgtatccgacattgctttttgattataacaatattcatgatttagcagcttatttagaagaaaaatatgatgtgcgtaatacgccggccgcagcttttaaagaaaaaacgcaaacgaaagagccgtctgaaaagccgatgcttgaatctttatatttacaaaaagaatggatagaatcgccattaaagtccggagaagtgcctaaggaaaatacattgattttcgatttcggcagttcattgagtgatgaaatccgaaagtacatcggcagtgaaaatgttatttatgcggaagccgccgctgaatatgaaatggtaaatgaaaagcattataaatttaatccggagcagtctgctcattacaccagactgttagatgatatgaaaaagtccggagcgtttccggcgtcaatcattcattacctgtcaaaacaagcttatactgaggcagcgttagatttgactcacagcttttattcaatcctttatttaagtaaagcgttgatccgtcaaaaaataaaagataacatcaaccttttgtacgtacatgacaaggatcaatatacaaatccgatttacgccgcgattggaggcttttttaaaacgcttaatgcggagcagccgaatataaagtgtaaaacggttgagatttcttcaagacaaaccattgaaaaagcatctttgcttctcaatgaattaagtgccggacatcatgaggctgtgaaatatgacggcgatcaaaaaaggcgggtgacagcatacaaagatgcttcgctgcaaccagggcaaaaggccgcaaagtttgtaaaaaacggagtgtatctcataatcggagggttaagcggcatcggctggattatttcagcgtttatttatgcaaatcacggagccagcgttatcattgccggacgatcgaaaatgacagcagaaatggaagaaaaattagacagcatccgatatgacggggcaaacatttcttacatccaggctgacatgtcagataaacagcaggtcatcaatttagcggaaaaaattcatgctgattattccgaaatcaacggggtcatttacagtgcaggcgtgttaaaagactctttcattatgaataaaacagacgcggaagctcaggcggtgctgcaatcaaaggtcaatggtgtgattcatttggatgaagcgctcagaaatatgcctttagacttttttgttttgttttcttccatctcttcagaaatcggaagtttgggtcaagctgattacgcctacgccaatcgttttctggagcattttgccgagtggagggaatgtatgagaaaggagggggggagatcaggaaaaaccatcgctgtaaattggcctttctggaaagacggaggcatgtcagttgatgccggcattcaagacattatgaaaaccgagtacggacttcacccattagaaaatactgccggaatcaaagcttttgaacactcgcttctcggccaaggccaccagctgatcgtgttatacggagaaaaagaaaaaatacaaaataatttcaatccgttatccgcccgttcagcaccgcctctggtaagagattcagcgattgcagccgattttgatgcttcgtcaatcgttacggaagaagaagctgaaagtcctttccgaatactcggcacagcttccaatcgtcatctagacgattatttgcattattggagcagactgaagaaaggagcccttcagcacgatcaaagcgatgccgcaaaaaaactcatcgctttttaccagacagaagaaacggaaaccgttcattttctggctaacacagaaaatgcccggcatatggaaatattgatgagcggtaagggtgaaacaattttactgatttgcggttttgctaccactgcttacatgtggaaagaacaaatgaaggagtgggcagaccaatttaatgtaattgtcatacacacaccgggttacgggctgagtgaggggagcgccgattttacactgagcgggctggctcagacttttattgaagtgctgaacgagataggggttgcttggccgatccacattgcggcagcttcttggggaggcatgataggacagaggatagcctatgaataccctgaaaaagtaaaaacactcattctttccggaagttacaccgaatacgaagaagaccctgaaagcagtgttgaggaaaaactgaaaaatgattttatagctataggaaaatcgcatgaatatgaaagtttatacaggaatcaattcttaaatgcttctattgaacgttttatgaagatacatcaacaagaaggctattctacgatcggctttttaaaagacatttatacaagaacgcttatccttacgggagagaaggaaagcgtagttgatcagaaagaaacaaaaaggctgaagaaactgctgagcaatgcagaattaaagaaaattaagggagcggggcatcttccgaacatcacacacccggaagaatttaataaagcggtgtcagaattcatcaagaaatcagtaagtaagggatgaaaacgatacatacagtacagggggagaaaacaatgaaacaaacaataagcaatccggcatttgatatgaaacaaattaacgctcttaacagccattatcagacgatgatagacaatggagatctgcaatgcgcgagttatatgatatcaagaggaggcgaggtttttgcggctgagtcgttaggggaatttaccggcggacaaaaagaaaagcaaacatttcagcttgatacaatcagagaaatcggttctttgacaaaagtgtttaccgctgcagccgtcatgcagctcgtcgaaaaaggtctgctcgatctgaaaatgccggtcaagctcattttgcctgcatttgataaaccgggtttcggagacattaaaattttacaccttttgactcatacggcgggattaagttttgagctggatattcaaaaggctgaaggcattgacttaacgaatgaggaagaatggataagctatctggtcagtacgcctttagagtacggagtggatgaagcatggaactattccagaaccggctttgtcatacttggcatcattatttccaaagtaacaggcatgtcctacgaacagtatgtaacaaagcatattattgaagcgctcggattagaaagaacgtttttttatgtgcctgatgctttaaaagaagaagtttgtgtgatcaatgagcacgagtgcgtacagctggaaaaaagtcatcacccgtattttccgaataaagcgacaagcggtctgtactcttcattggaagatatttggaagttagctgaaatgtttagaaataaaggcagattgaaagataagaagctgcttggaagaaaaacagtcgaggccatgctgagaaatcaaataaagcccggtcttcctttttacttcttcggagcgccaagagaggagggcggctttggtttaggcattaatttgtggccggccggtgaccattatttcatgacagaaggcacgttctcacatcttggaatgggttggtgcggcatgttttctgatccagccgaagattttacgtatgtatttttcactccgatttccgagtttcatcctcatgccgtactgacgccgctgaatatcgtgtgggcgggtattgaataattagacaaaagcatcgtcccgcctgttcggcaggcgggacgattgctaactgcccgtttttatcccgcggcaccttctcaaagcctgccctcgaagttaaataacttaatttactctttgtaattttttttaattatagtacagtagagcgtttttataatacagtttaaagtcttttatagtacagtttggcgcagtatgatcttaagttttataagcggtttcaaaataaggttataaataattgacggctttgtttaattactgtaaactatggttgttgatcatattgtactaataaaaaatctttttttattagtacagtttaaacgtcattatctttgcttaagcgctatgtgaatttctgaatgattaattttagaattgcagagcatgataagactgtttttaatacggatggctaaacggtatcctaaccctgttaaatcaaaagaagaggtggtttaaaaaatggctgcaaagacaaaaacttcaattgttgatagcaaaaaacaatttgatgctattaataagcagtttgaaacgttccaaattttaaatgctgaaggagaagtcgtaaataaagacgcaatgcctgatctttcagatgatcagttaaaggaattaatgagaagaatggtgtatatccgcattttagaccagcgttcaatttctctttcccgtcaaggacgtttaggtttctatgcaccgacagcgggccaggaagcttctcaaattgcatcacacttcgcgcttgaacaggacgactttatccttccgggttatcgtgacgttcctcagctgatttggcacgggcttcctttacatcaggcattcctgttctcaagaggccattttaaaggtaatcagatgcctgagggagtaaacgctttatcacctcaaattattattggtgctcaaattattcaaaccgcaggtgtagctttagggcttaaaaagcgcggtaaaaaagcggtagctattacttacactggtgacggcggagcttctcaaggtgacttctatgaaggaatgaactttgccggagcatttaaagcgccggcgatcttcgttgttcagaataaccgctatgcgatttcaactcctgtagaaaagcaatcatccgcacagacaattgcccaaaaagcagttgccgtcggtattacaggtgttcaagtagacggaatggacgcactagccgtttacgctgcaaccgcagaagcacgccagcgcgcaattaacggtgaaggtccgactctgattgaaactcttacattccgttacggacctcatacaatgtccggtgacgatccgactaaataccgtacgaaagaaatagaaaatgaatgggagcaaaaagacccgctcgtacgtttccgcaagttcttggaaaacaaaggactatggtctgaagaagaagagaacaaagtgattgaacaggccaaagaagaaatcaaacaagctatcaaaaaggctgacggcgaatcaaaaccgaaagtaacagagctgattgagaatatgtttgaagagccgacgttcaacttgaaagaacaacttgaaatttacaaagcgaaggagtcgaagtaagccatggcgcaaatgacaatgattcaagcgatcactgatgcgttacgcacagaactgaaaaacaatgaaaacgttctgcttttcggggaagatgtaggcgttgccggaggcgtattccgtgcaactgaaggccttcaaaaagaattcggtgaggaccgcgtatttgacacgccgcttgctgaatccggtatcggcggtctcgctctcggtttaggcctgcaagattaccgtcctgttatggaaatccagttcttcggatttgtatatgaagtaatggattcaatctcaggacaaatggctcgtctccgctaccgttccggcggacgctggacttctccggtgacaatccgttctccattcggcggaggggttcatacacctgaacttcacgctgacagtttggaaggccttatcgctcagcagccgggtattaaagttgttatcccttccactccttacgatgcaaaaggactgctgattgcctctatcagagacaatgatccggttgttttcttagagcatatgaaactttaccgttctttccgtcaggaagttcctgaagaggaatacacaatcgagcttggcaaagctgatgtgaaacgcgaaggtactgacctttctatcatcacatacggcgcgatggttcatgagtcgcttaaggctgctgaagagcttgaaaaagaaggcgtttctgctgaagttatcgaccttcgcactgtaagtccgcttgatattgatacgattattgcttctgttgaaaaaacaggccgcgcaattgtcgtgcaggaagctcaaaaacaagccggcatcgctgccaacgttgtagctgaaatcaatgaccgcgcgattctgagcctggaagctccggttctgcgtgttgcggcgcctgatacagtatttcctttctcgcttgctgagagcgtatggcttccaaaccataaagacgttcttgaaactgcgaaaaaagttcttgaattttaatcaggcatcttaaaagacggtaaagagagtccttttctcttatgatgaaggagtctgtttactaggttcaatgcttgcgtatgcataactaaaatttgcttaatcaactaggaggtcgaaaactgtggcatttgaatttaaacttccggatatcggggaaggtatccacgaaggcgaaatcgtaaaatggtttgtgaagccgaacgacgaggtagaagaagacgatgttctggctgaagtgcaaaatgataaagcagtggtagaaattccttcacctgttaaaggaaaagtattagaattaaaagttgaagagggaacagttgcaactgttggacaaacgattattacgtttgacgcacctggttacgaagatcttcaatttaaaggaagccatgattcaggagaggcgaaaactgaggctcaagttcagtcgtctgctgaagcagggcaggatatctctaaagaagagactcctaaagagcctgcaaaagaaaccggcgcaggacagcaggaccaagcggaagctgatccgaacaaacgcgtgatcgcgatgccttccgtacgcaaatatgcccgtgaaaaaggcgtggatatccgtaaagtaacaggttcaggcaataacggacgtgttgtaaaagaagatatcgacagctttgcaaatggaggagcggctcaagaagcgggaccgcaagaaacagctgcacctcaggaaacagctaaacctgcagcagctcaggctcctgaaggcgaattccctgaaacacgcgaaaaaatgagcggtatccgtaaagcgattgcgaaagcaatggtgaactctaagcatactgcaccgcacgtaactcttatggatgaagttgacgtaacaaatcttgttgctcaccgtaaacagttcaaacaagttgctgctgatcaaggcatcaagctgacttatctgccttacgtcgtcaaagcattaacatccgctttgaaaaaattccctgttttaaacacatcgattgatgataaaacagatgaagtgatccaaaaacattacttcaacatcggaattgcagcggataccgaaaaaggcctgcttgtgccggtagtgaaaaatgccgaccgtaaagccgttttcgaaatctctgatgaaatcaacagccttgctacaaaagcgcgtgaaggcaagcttgcacctgcggaaatgaaaggcgcttcttgcacgatcacaaatatcggttctgccggaggccaatggttcacaccggttatcaaccacccagaggttgcgattctcggtatcggccgtattgctgaaaaagcgatcgtccgtgacggtgaaattgtagctgctcctgtcttagctctttctctcagctttgaccaccgtatgattgacggagcaactgcacaaaatgcgttaaaccacatcaagcgtttactgaacgatccacaacttattttaatggaggcgtaatgttatggtagtaggagatttccctattgaaacagatactcttgtgattggtgcgggacccggcggctatgtagctgccatccgcgctgctcagcttggacaaaaagtaacagtcgttgaaaaagcaactcttggaggcgtttgtctgaacgtcggctgtattccttcaaaagcgctcatcaatgcaggccatcgttacgagaatgcaaaacattcagatgacatgggaatcactgctgagaacgtaacggttgactttacaaaagtccaagaatggaaagcttctgttgtaaataagcttaccggcggtgttgcaggtcttttaaaaggaaataaagtggacgttgtaaacggggaagcttatttcgtagacagcaactctgtccgcgtaatggatgagaactctgcgcaaacatacacatttaaaaacgcgatcattgctaccggttctcgtcctatcgaattgccaaacttcaaatatagcgaacgcgttctgaactctacaggcgcactggcgcttaaagaaattccgaaaaagctcgttgttatcggcggcggatatatcggtactgagcttggaacagcgtatgcgaacttcggaactgaattggttattttagaaggcggagatgaaattcttcctggcttcgaaaaacaaatgagttctctcgttacccgcagactgaagaaaaaaggcaacgttgaaatccatacaagcgccatggctaaaggcgttgaggaaagacctgacggcgtaacagttacattcgaagtaaaaggcgaagaaaaaacggttgatgctgattacgtattaatcactgtcggacgccgtccgaacactgatgagctcggccttgagcaagtcggtatcgaaatgactgaccgcggtgtcattaaaacagacaagcagtgccgcacaaacgtaccgaacatttacgcaatcggtgacatcattgacggacctcctttggctcacaaagcgtcttacgaaggtaaaatcgctgcggaagctatttcaggagagccggctgaaatcgattacctcggtattccggcggttgtattctctgagcctgaactggcttctgtcggttacactgaagcacaggcgaaagaagaaggcattgaagtcgttgcagctaagttccgtttgcagcaaacggacgtgcgctgtctcttaacgaaactgacggcttcatgaagctgatcacccgtaaagaagacggtcttgtaatcggtgcgcaaattgccggcgcaagcgcttctgacatgatttctgaattgagcctggcgatcgaaggcggaatgactgctgaagatatcgcaatgacaattcacgctcacccgacattgggcgaaatcactatggaagctgccgaagtagcaatcggaagcccgatccacatcgtaaaataatgatgtaacaaagaaacagcccccgtttgtaaaagcgggggctgtttttattgtgcaagcacatgctgcataggtttgatgatatcctcttttttctttacggatccctcaatcttcatgaccacatgccgatgattgatcaccatcagcgcagggaacgtgttgatttcctcttcccatccctttctgttgtcataaaccttcatttgatcgacatgatggggatatttcttttctaaatcaagaatcgcatcgtaataaggaacttctttatctatatgattttcatcggaaaaaaacaagatttgagtgtgatgaatgctgtcgatccggttatttttgaatggaatgacagtagaaaccgaacagcttgacagaacgaacagcatcaaaaaaaagggaatcaccgtacggtagcgcatctatcttactcctctgttttatataatatattggttcatccatttataaggactatattaagtgtatcacgagaggtgaaaaacctaaggcttgttactgaattgttatataattgaaaccgtttttaatgaagaaataatacgtgtgacaacttgcacagccgatgtgtaaaaaaggcacattgtttttcgtgagagcgctgttttttcgttatactgggggcaaaaccatatcaggagggattgcatgtataaagccattgcagccgtcatatgtatgtgcttactcgccggctgccaatcaaatgaaaagatgcaaacaaacaaaccccattctcaagccgcggccaatcatgccaaacgggaaaaccatcatacaaaagagaaaaaacagaaggcggagccccgttactatatcaatccgaaaaccttttctgtggaaaaaatggatgaacagaaagagaaaaaaccgatcgcattggtaacgatcgatgacgcgcctgatcagcatgccgctgagattgcggacaaactgcatgatctcaatgcgtcagcgatcttttttgtaaacggacattttttgaaaaaagatgaaaataagaaagcgcttaagcatattcatgagttaggttttatgatcggaaatcatacaatgactcatcaaaacttaaaagatctttccgaacaaaaacaacgggaagaaatcattggcgtcaataaagcggttgaaaaggtaataggagagaaacccgcatttttcagggcgcctttcggaagcaatacggactacagtgacagacttataaaaaaagaaggtatggtgaaaatgaactggaccttcgggtatgattgggatcagaaatatcaatccaaaaaagcgcttaccgatatcacactgagcagtccttacctgcgggacggcgccaacatattgatgcatgaccggaaatggacggctgaagccatgccggacattgtaaaaggattgcgtcataaaggatataccgtgattaaccctcgagctataaaaagaccgtaaaaaataaatgtgttatacaatttatcagttgacatattaaatgtgacataataatataataacaacaagtaaaaattaagcgttttcaaattctgagaaatggggaatgacagatgggtacaattgtttgccaagactgtaacgaagcgattcattactttgaggatgagaaggtcacgacgttatacggaacatgctgcggacaatgccagtgtcatcttgaagaagagtaaaaagcgtaaaaaaggcccgaaacgatttcgtttcgggcttctttatgtttattggatggctttttgctctttgatgactctgatcatttcaagcgtggcatcttcgggaccctgcacaggaaggccggcgtccaagtttttaaaaatgtagctgatattttcttcagtaatgatctcacccggaataaagatcggaattcccggcgggtacaccatgacaaactctgcaatgatccgtcccgcggattctgttaacggaatgacttccgtatttgcgtaaaacgcgtctcttggcgtcatcgctaacagaggaatctcaggaagcagaacttccgtttgctgatgagcataatcatttgcggaagcctgctttgaaatgtctgtaagcgcgcttacaagacggtcggcatctcctgctctgtctccgggggtgaaaatacataaaatattatacaaatcggacagctcgacttcgatattaaatgattcgcggagccatttttcaacgtcatgacccgtcaggccgaggtttttgaccgaaatgattaatttagtcggatcataactgaaggcagcttttgacccagtgatttcttcgccgacacagcggatgccttcaatttgattgaggcgttcccgtgtctgatccgccagcagaatcgtatcttcaagaagatcgcggccttctgtagcgaggcgttttcttgcgacatccagtgaagcgagaagcagataggatgttgacgttgtcgtcagcatgcttaaaatcgactgtactctttctttggaaacaaggccttctctcacatttaaaatggagctctgcgtcagggagcctcccaatttgtgcacgcttgtggctgccatatcagcgcccgcctgcatggcggacagaggaagcttatcatgaaaatgaatatgcacgccgtgcgcttcatcgacaagaacaggcacatcgaaagaatgcgcgagctttacaatgctgctcaagtcagctgccacaccgaagtatgtcggattgatgacaagcaggccttttgcgtcagggtgttccgtcaaagcccgctcggcggactcaagcgtaatgccgtgagaaattccgagctcatcgtcaatttccgggtgtataaaaatcggcaccgctccggaaaatacaatggccgacataatggatttatgaacgtttctcggaatgatgattttatctccgggtccgcatacggccatgaccatcgtcataatggcgccgctcgtcccttgtacggaaaagaaggtatggtctgcgccgaatgcttccgcggccagatcctgggcttctttaatgatgccctttggcgcatgtaaatcatccaggggttcaatattaattaaatctatgcttaacgcgttttctccgataaattgtctgaattccggatccattcccgcgccttttttatggcccggaatgtggaattggacaggctgtctgtccgcgtgctttttcagtccgctgtacaggggtgtttcatgttgcggcaattgttttcccacctttatcataatacctacggattagtttgtattacattcagttttattacccgttttttaaacgtaaaacaaatgaattatattatgaacttgaaagaaagtaaagaacaatttatgatctatggaagatgcttatttttgagcatgatgataaaggagtgaagacatttggaatatcaatatccgatgaatgaggactggacgacagaggaggccgtggatgtcattgctttttttcagcaggtggaaaacgcctatgaaaaaggagctgaccgagacagacttctgaatgcgtaccgccgctttaaagaaatcgttcccgggaaagcggaagaaaagaaaatctgcagccaatttgaagctgacagcacctattccccgtatcggactgtgaaacaggcgaaacaatcagatcaagcgattatcaaaatgtagacaaaagcgagccggcaatcggcccgctttttatgttatgagactttctgagtcagtgtgtataaaaaggaaagcttcctaaaagcatcttcaatggtttgcaggaattcattgttgttcatgttgatcacgtcttctttttgcagctgaatgccgcataaaagctctgcttttttcactgtctgcaggcgttcaaataatgttttcagctgctcctgatccatgtcggactgcttgtacgcacctggcttcgtatgatccggcgaccatacaaaatgaccgggaatctgttttgtgatttcctcctgcttcgcttccagcaatctgccgtattcctcttttatcggagattcataaatgatggcaaaccatacaaacatatgggtgtcccataaaccgatctgaaagtgagggagtttcttatagccgcgtttgctgttggcaaaggcaacccagctgtcagccggcgggttgacagatcttctcgcgtgcttggcgacatgcgggaacatttcatctcctgtcaatgctgacaatgtcggtgcgaaatgctctcctaacaaggtcagcttcggacggacttgttcttttaacacctccatgcgcggatctaaaccttctattgtaaatgtatcgaagtcttcttttgtaaaacgcatctgagtcatctttttcctccttaacgtaagtattcatattttaccacagccgccgcccgccgcaaaaacattgagaacgtttgagtcgagaggaatggtggtaaaaaacgaataggtaaacacacaattttaagaatgttgttacagccgaatataagtttccatacgatataagaagtatcattaatgaattggaaaaatgggatgcttttttaacaaatgatctctggaaggggcgaaagacaatgaggcaagtggtgaaggaaggattcagggaggaaaaaaataaccgtgtagctgtctggagactagaggttgattatgaattggcaaccctgtacgaggccatgcaaaaagagaatgaagatcaaatcgatctcagcaaaagaaaactggaacgtctcagaaaagaatggattcggcttaacggataaagaatagtaaaaacgaaccgcaggaaatggttcgtttttacgtgagaaggcatttttttcattttccttgctttttcatcgcctttatcagtatgctatagaataagctatacatagaaaagaggtacacggtatgacaaattggacggaaattgatgatatcgcaaaacaatgggtaaaagaagccggaacgagaatcagacaatccatgcaggaaagcttgacgattgaaacaaaatcaaatccgaatgatttagtcacaaatattgataaagagacggagcgctttttcattgaccgtatacaaggaacttttcccggacaccggattctcggagaagaagggcagggggataaactccgctcccttgacggaatcgtctggatcattgatccgattgacgggacgatgaattttgtccatcaaaagcggcatttcgcgatctccatcggcatctttgaagacggaaaaggcaaaatcggcttaatttatgatgtgatgcaggacgaactgtatcacgcattcagcggaaaaggggcttatctgaatgatacgccgcttgctcctttaaaagaagcttccattgaagaagccattattgcaatcaatgccacatgggtgacggaaaacagaaggattgacccgagtattttggcgccgctcgtaaaacgggtcagaggaacgcgttcctacggttcggcggcacttgagctggccggtgttgcggccggccgcattgacgcatacattacgatgaggctcgcgccgtgggattacgctgccggctgcgtgctgctgaacgaagtcgggggcatttacacgaccacagacggcgaaccgttcacgtttttagacaaccacagcgtgcttgcgggcaatccggctatacataaaattatctttgacgactatttacatgctgacaggtagagattttgaagaagaagatctcgggtttctggagcagctggcggcatcacacccggtgtggaaaaacgaagagttcggaacaaaaaatgcggcggagtttatgcttgcatactccatgtacaatggaacgtggctcgtatgggagattgacggcgctcctgccgccgtcagttttcatttggaatgggcgccttcaaacggaaaaccgtggctcggaaccgtggccgtcgctccggaggcaaaagagaaaggaatcggtcgcgcggtcattgaagagattgcgggccggctgagaggagagcataaagcgatgttttcagccgttcccctggacaggcaggaatgggttttgtttttaagccaatgcggctttgaacagcttaagcttgaaaaagacgatcgggaaaagacatatatgatcatggtgaagccattgtgaaatgttcagatataaaaaagagaccggatttctccggtctcttttcttgtttacaagccgaccgcattccaggccgcttctacgcttgcagcgtcttgagagccgtaaaggtcccgcgctgattgaatcaaagctgcttttgcatctttaaagcttgatgacggagtgagatataccgtcagtgcgcgatagtaaatctgctccgcttttttcactccgatttttgtaatcgtgttgtaagcggctttgttcggaattccgctgtttgtatgcacgccgccgtagtcgccggcatcagtgttcggaaggttttgataatttttgtaatggtcgggctgtccgtattttgtcggattggataagctgcggagagccggctggctgaccgtaatatcctcaccgatatcccagtcctcagtatcggtgaagtacccgaatacatcggagaaggattcgtttaaagcgcccggctgattttcatagttcaggttggctgtttcctgtgtaacgccgtgtgtcatttcatgggccgttacgtccattgaaccggaaagaggcgagaagaatgagccgtcaccgtcaccgtaaatcatttggtcgccgatccaggccgcgttattgtatctgctgccgtaatgaacggaagatacgattttgccgcctctattgtcgtagctgttgcgtttaaacgtctgatagaaataatcatacactttgccgagattgtaatgcgcatcaaccgcagcgcgctgagaagaagttgtgaactggtttgtagtgcttgatacgagcgtgcccggcaggttatattgtcggttttgcagatcgtacgtaataatttgtgttccggtaggcttcgaaagatcacgcattacatatttgccgttttcagaagaaatatttaatgagaccgtttttcctttaagagtcgtacctgttccggttgcagcggcatgctccactttgttttgctttttcaggactttccctgtttccgcatcaacggttacttcccagttagctggttccggttcgatgtagcggatggttacatcataggcgagtcggtatttaccgtcttttgtggccgctgctttcagctcggctttgtttttgtttgcaacgttgccgttggagacggcttcaggtgatttgccgattgctttaaaagcatgatccagcgcctgatttgcagataattttttgctgtttgccgttttggcagaagcatcgttgtttaattcaccgttaatcgcatagacattgttggatttatcgacgtgaataatgacttgcgagtctttcacaggcacaccgttaacgacaggcacataacggaagtgcttatagccgagatcatcggtcgtgtggtcaatcagcttcagtctctcagaagggttgcctttgaagactttgccgttttgtttcaagtattgcttgattgctttgtcactgactgaaggcaattcagattgcaccaaagaatgcttcggcacaaagttcgtcaggttttctttaagctgaggattctcagcggcctgaacacccggaagactgatggttaaactcataaaggaagcggcgacagcaacagacaatttcttacctaaacccacaataaatccccctttttgaaaataatgaaaacttatattgttataataaaccagcattctctcattctgcaatataaaactagacttcgctgatgaattgatagaatcgtcccgtaaaggcttcaggcgggcagcgtcaggggataagccgagaggcacgtgttgaatcaaacatgagtcgaatgatgcgatttattctgaaaaaaatgacaaatgaagtcgggagaaataatagaggaaaaatgttccgatctgtaaaactttttttatagccgtttgtctaaacaggtgaggccttaataaacgaaaaggattgtttcagatgtcagagattttcagtcattttattcagcatttcgacagatatttcaagagctgtcttacgaagagattgctgatgttttggactggagtctttcgaaggtgaagagcactctgtacagggcgagaatgcagctgaaacagcacttagcggaaaaaaggaaggacggacagatatgacttgctgtttagtgagagatttactccctatatatattgaaggcgattgtgaaacagaaacggagcggtttatttcccgccaccttgaatcatgcggtaagtgcgaaagtttatatcatatgatgaaggagccgcttgacctcggcagccccgagatgaaggagcccgcctgttatgcagaagaagaaaggcggtttaaggaacggtattacgggaagctgctgataaaagcagcctgtttgttcggcgctgttttctttatcatgctgatctttaaactgctgattaaaaaaaacgcccggctgcatgacatgaccgggcgttttatccgtttactcagccggatgaaaggctgtataaatgccttcaagcaagtcctgaggcagtgaattaaagaatccggcacacagctttgcttctttttttcctgctcctgctttttcagcaaggtcctgatcaaacgtatacacaccgtcttcttcaatcagcgcagattgaaggatatgaagactttgggaaaaagtggtgaacagctgatcaacgataagggcctctttttccgtaaatccgagctccaccgctttttctttattaaatgtatattcgccgtccgttttctcaatacattgagaaagaacggttaaaaattcggttgaactgtcccacagcttttgaatggtctgtgcggcttctttatctaatcccaattcaaccgctttttcaccgtcaaaataatagacgccgtctttttcgtaaatcgattggctgatgatgtcaatgagttttgccgcgtcttccggtgttttctctgcggaaacctgcagggtatgcggttcatttgcctggatcgtttttgcgccggcagaatcaagcggactgaatgcaagcaaggcggctgaggcggttgcggcggcagttacagcggttttcttcaaaaaagatgttttcatttcattctctccttgtcatgtgtatttgcttacagtcacaagtataaaaagacaatgatggaattgatataggaggtatggtattttctgcataacgatgccggactatttcagactgtatattctgagggaatctgctgatgtaactagaatgggggccgtcattcccggcttcctgactagacggcgggggagataagccttacatctggagtctgtttttgaggaggtaaaaaagcctgaatctttgattcaggcttcataagatattgtctttccatgtttacggaattttgcaaagggtcatgcttttaatcaagcagtccctgttcgcgcatttttttctttacggtgaaaccgcttcccatcatggcgataacgagaacaatgcttccgatgatgccccatgcgcttttctcagcgattgatacgccgatcagcatcatgctgaagactgctgcgaatgcaaataataataagagccaattcaattttttcatatttccatcccctttaacgtcatactttcagtttacagaaaaacgtaacgcttttaaagaggatgtgtggtataatatgaaagttatctaatttttttaggagatgaaaatgtgaaacttcgaaacgatcttcgcaacatcgcgattattgcccacgttgaccatgggaaaacgactttggtagaccaattgcttcaccaagccggaacattccgtgccaacgaaaatattgccgaacgcgcaatggattcaaacgatcttgaacgtgaacgcggtattacaattcttgcgaaaaatactgcgattaactataaagatacacgcattaatattttggacactccgggacacgccgacttcggcggagaggtagaacggattatgaaaatggttgacggcgttctgttagtcgttgacgcttatgaaggctgcatgccgcaaacccgtttcgtactgaaaaaagcccttgagcagaacttaaatccggttgtcgtcgtaaacaaaatcgaccgtgatttcgcccgcccggaagaagtcattgatgaagtgcttgatttgttcatcgagcttgacgcaaacgaagaacagcttgagttccctgtcgtctacgcttctgcgattaacggaacggcaagtctggatccgaaaaagcaggacgaaaacatggaatcactgtatgaaacgattcttgaacatgtccctgccccggtagataacgccgaagagcctcttcaattccaagtggcgctgcttgattacaatgattatgtcggccgtatcggtatcggacgcgttttccgcggaacgatgaaagtgggtcagcaggtttcattgatgaaacttgacggaacggttaaatcattccgtgtaacgaaaatcttcggtttccaaggattgaaacgcgtggaaattgaagaagcgagagcgggagaccttgttgccgtttcgggcatggaagacatcaacgtcggtgaaacggtttgtccggctgaccaccatgagccgctgccggttctgcgcattgatgagcctacgcttcaaatgacatttgtcgtaaacaacagcccgtttgcaggccgtgaaggcaaatatgtcacagcccgcaaaattgaagagcgtctgaatgcgcagcttcaaactgacgtcagtcttcgtgtcgaaccgactgcatcaccagacgcatgggttgtttcaggacgcggtgagcttcacctgtccattttaattgaaaacatgcgccgtgaaggctatgagcttcaagtgtctaaacctgaagttatcattaaggaaattgacggcgtcagctgcgagcctgttgagcgcgtgcagattgacgtgcctgaagagcataccggttctgttatggaatcaatgggtgcgagaaaaggcgaaatgcttgatatgattaataacggaaacggccaggtccgcctgatctttaccgtaccttcacgcggactcatcggctattctactgagtttctgtcactgacacgcggtttcggtatcctgaaccacacgtttgacagctatcagccgatgcaaaaaggccaagtcggaggccgacgtcagggtgtgctcgtttccatggaaaacggaaaagcgacatcttacggaattcaaggtattgaagaccgcggcgtcatcttcgttgagcccggaacagaagtgtatgaaggcatgattgtcggcgaacataaccgtgacaatgaccttgttgtcaatgtcagcaaaatgaaacagcagacaaacgtacgttccgctacgaaggatcaaacgactacgattaagaaagcgcgcattatgtcgcttgaagaatcactcgagtacttaaacgaggatgaatactgcgaagtaacgccggaatccatccgtttaagaaagaaaatcctgaataaaaacgaacgtgaaaaagcggcgaaaaagaaaaaaacagcaggaatgtcttaatcacttgcagaatttgaaaaggtagaacccgaacggaaaaggggagggggatctttttgaatgaagtaagtgaacggctgtcgttctttgcggctctttaccaagtggatgagcatccgctggcgggaatgtggctgttatacggaacgatcgtcgtgctttcggtgattgtatttaaactcggctttgccaaacggctgccggttttgaaggctgcggcagtttatctctttctcgtgctcggctgcaccgtgctgacttttttcggtgtgtttttgccggtcggagaagggcttgttgtcgccgccttgattttgatcatttacaaaatccgtctgcaccagtccaaaaaaagccagtcagctaaaccgcaataaaaaaatgaccttgccttccggcgggtcattttttattgcggtttattttttcagtttatcttttttcgctttttgtccaggatgaaaggaaaagtgtccggtattcagccgcgcctccgttttgattttgattcggtcatggcattcccggcacatatatgtatgaatcggacgattgcggaggcgtttggctgtcagtgtttcatcatcaatttgttcaattttgtcgcaaatggaacattttactctcattgattttcacctctttcactatgacaagcattatatcatggatgcccctcctgccaaagggaaagaaagcagcgcccttcttttggagcgggcgctgctttttactggcggtttttcatatgatgatccgattgatcgttctgttcgttctgcagcttgttctggtctctttggttcagctgatcatcattcgattgagtcggtgattctttttcattgtcggtcacatcattcgggacttccggcatgacacgaccgacgatggcggcaagttcgtccaaaatgcctgaaacggggcggccggctttaatgtcgctgcccatgcctctcagacgggaaaccgtatcaggatcagccacgacaacggcattggcgccgtaaggatcgttttttaacgcctgggcgaccgtgtatttaatgctctccactttgcttctttctaaattgtcatccacatcgattccgacaacggagtatcttccgagtacaaccgcggtggcatctgaaatgccggggattttttcggttacctcgacgagatgcttagcgatgtctgtccggccgggattttcagctgtctcaggagccgtattttttacatgaatcggttttgcatcacgctgatcggttgattcgttctggatattgcggccgcggccgtcctgtacagcagtgcagccggtcaggataaacaaggcttgtatgataatgaaaagaattcgcacgtcagattccctccttgaatgctttcatttattttattgttgaattaaccttctatctttattcaccaaatcatatattttagcaggcatccccgtttttcgcggaaagagaagcacacgatgggctttgatccttatttcaggaggctgagacttgagtaaaatttatgtgttagatacgaatgtacttttgcaggatcctaacgccattttttcctttgaagaaaacgaagttgtcatccccgccgtcgtgctggaagaggtcgattcaaaaaagcggtatatggacgaggtcgggagaaatgcgaggcacgtatctaagctgatagacgggctcagggagaaaggaaggctgcacgagaaagttccgcttcaaagcggaggaacgctcagaattgaactgaaccaccggtcatttcatcagctccaagaaatttttatcgaaaaaacgaatgataaccgcattttggcggtggcaaaaaatttaagccttgaggaggaaacgaaagaaaacggccgcctcgtcatcctggtcagcaaagatgtgcttgtcagggtaaaggcggatgccatcgggcttttggcggaggactttttaaacgacagagtcgttgaccatcatgaaatatatagcgggtacaaagatatatttatgaataaagagcggtttgcctcgttttataaaaacaaacaaattccagtcaaggagcttcagcagcatcaggtttatccgaatcaatttgtgctgatgaaagatgaattaggaggatcttcgtctgcggtcggcatggcggataagaaaggagagaccgtaaaaagactcgttttcgatgatgagcacgtatgggggatcaggccgaagaacgtccagcagacaatggcgctcgaactcctgctgagggaagatatcccgcttgtcaccctgatcggaaaagcgggaacgggaaaaaccttgcttgctctcgcggcagggcttctgcagacggaggatctcggtatttataaaaagctgatcgtcgcgcgtcccatcgtcccggtgggaaaggatatcggatatttgccgggcgaaaaagaggaaaagctcaagccgtggatgcagccgatctttgataatcttgaatttttattcaatgcgaaaaagccgggtgaacttgaagcgattttggcaggaatcggatcgattcaggtggaggcgctgacatacattcggggaagaagcattccggatcagtttattattatagatgaggctcagaatctgacgaggcacgaggtcaaaacgcttttgacaagggtgggagagggcagcaaaattgtcctgatgggcgatccggagcaaatagatcacccatacttagacagtttaaacaacggacttgcttatgttgtagagcggtttaaaggacaaaccgtctccggcagcgtgaagcttgtgaaaggtgagagatccggccttgcacagcttgccgccgatttgttataaaacttcgatttctgtgacgcccgttatcggtttttcaaagtctccgtccacgtaaaaatggaccggaccgccgtcttgaagcggtttccccgcatcgctgaaatgcgcgattgcgtccatcgccttttcaagcggcacttcggttctttctgattttgaaataaatgcgcacaggacagcgctttctttcggctcggcatttgctaaaacagcgccgagcttcatggcgaagctgccgttcatcagtctttctttttcataacgtttttcactttttaaagtcggcggcgaaatgcgcccttctctgatcacccgttcaggatcaagcgtatgctcctgggtttctgcagagccgtcctgatgaacaggctgattgttttcaaacggaaatttgcggtcatcgaaaatccagacactcggatcaattgtaatcgggtatgtaacattgccttttacttgaataacgctcatgttgaagcccccctttacttaaagtataaaagttttcgcatgaattgtcactttgcgttgcaaattagatgtatacaacggcagcgaagtgaggatgatcgacatggtatgccggcattaccaagagctggacgcattagttcaggaagcgaaaaaaagaaccggagaaggcaaagtggcagactatattccggctctggctgaatctgaacaagacagcctttcggtcacgatttatcatgcggaaaatacatgtctgacggcaggagacgccgaccggacatttacgctgcagagcatttcgaaagtgctttctctggcgctcgtactgatggattacggaaaggaaaaggtgttcagctgcgtgggtcaggagccgaccggcgacccgtttaactccatgattaagcttgaaacagtgaatccgggcaagcctttaaatccgatgattaatgcgggagctctcatcgttacgggtttaattaaagggcattcgccgaaagaccgcctggattacctgctcggattcatcagaagacttgcgaacaatcaggacattacatattgcagacatgtcgcggaatcggaattcaaatcttccatgattaatcgggccatgtgttattacatgaagcagtatgacatttttaaaggcgatgttgaagaggtcatggatttgtatacaaaacagtgcgcgattaagatgagcagtctggatttagccaaaatcggctgtgtattcgcccttgacggcaagcatccggaaaccggggagcaggtcattaaaaaagatgtggcgagaatctgcaagacgtttatggtgacatgcggcatgtacaatgcgagcggggaattcgcaatcaaggtcggcattcccgctaaaagcggcgtttcgggaggaatcatgggcatttcgccgtacaacttcggaatcggtatattcggcccggcgcttgatgaaaaaggcaacagcatcgcgggtgtgaagcttttggaaatcatgtctgagaaatacaggctgagtattttttgaaacattttttatcataacatctgcttaaatcctcttgcaatttcatctgataccctttatgataaatagaagaattaggtactcgcctggggaacggagggatacttttggcttcagagattatagttgaccatcagcagaaagcattcgagctgttgaagttagatgctgagaagattttgaagctgatccgagtacaaatggataacttaacgatgcctcaatgtcctctgtatgaagaggtcttggatactcagatgttcggactgtcgagggaaatcgattttgctgtccgcctgggattagttgacgaaaacgacggcaaagagctgctggacagacttgaaagagaactgtctgctttgcatgacgcgtttacaggaaaataaatgatcaaactcaaactattcaacggtttgggtttttttataaccgtaaaccgtttttttgcatcttcttttcgtaagacggtctcttaatctgcatttcatccgaaaaactataaagaaactgcgtaaattgtttatgaattatagtaaaatataatacgcaataggtattaaacgtaagctttaagcaggaaagaggatgttatgtttaaaagaatgttaaaatcttacgattattcattgatatgcgctatcattctgctgtgcagtttcggattggtaatggtatacagctcaagcatgattaccgccgttatgcgttacggcgtgagcagcgactatttctttaaacggcagctgttcgccgtcatcgcggggtttgtgctgtttattatcgcggccgtttttccgtacaaagtgttcgcccatcaaaagattcagaaaatcatactgcttgcgtcagtggctgcgctttgcgcgctgtttgttttcggacatgttgccggaaatgcgcaaagctggtttaaaatcggcggaatggccattcagccgggggaatttgtcaagctgaccctgatactgtatcttgccgcggtgtacgcaaagaaacaaagctacatcgatcagcttttgacgggggttgcgccgccggtgatcgtcaccgtagtcatttgtgcgcttatcgctattcagcccgacttcggaacggcgatgattatcggtctgatcgcgttttgcgtcattatgtgttcgggattcagcggaaggaccctgctcaggctggttctcatggcgggaatcgtattactccttgtcagcccgatcatttatctgaaatgggacgatattttgacacccgggcgtatgagccggtttgaaagccttgaaaatccatttaaatacgccagcacatcaggtctgcagattataaattcgtattatgcgatcggctcaggcggttttttcggtctcggtcttggagaaagcattcaaaaatacggttatctgcctgaatcgcatacagactttattatggcggttatttcagaggagctcggcattttcggcgtcctgtttgtcattgtgctgctggcttttgtggtgttaaaaggtttttatattgcgagaaaatgtgaagatccgttcggaagccttttggcaatcgggatatccagcatgattgcgattcagacctttatcaatctcggcggtgtcagcggtttaattccgatcacaggtgttccgctgccgtttatcagctacgggggatcatcaatgtttttgttattgacgagcgccggtatattggtgaatgtcagcatgcatgtcaagtactcagaaaagaagaaaaagagggagcccgttccgtctaaaggggtaaaaagacggcagacggaaaaatctgtgtatctctaaaaaacaagtgtatacacagggcggatattcctttattataaactacatatttattaggccaagggggagaaaagtttgtcacaacaatccatccaaaaagtgttagtagcaaacaggggagaaattgcgatccggattttccgggcgtgcacagaattgaacatcagaacggtagccgtttattcaaaagaagattcgggctcctatcatcgctataaagcggatgaagcttatcttgtgggcgaaggcaaaaaaccgattgacgcgtatcttgatattgaagggattattgagatcgcaaaaagaaacggcgttgatgccattcatccgggctacggatttctctctgaaaatatccaatttgcgagacgctgtgaagaagaggacatcgtattcatcggaccgacgtcagcgcatttggatatgttcggagataaggtaaaggcgagggagcaggcggaaaaagccggtatccccgttattccggggagtgacggaccggctgaaacattaaaagatgtcgaacaattcgcaaaagtccacggatttccgtttattattaaagcatcgctcggaggcggaggccgcggcatgagaatcgtccgaagcgaaagcgaattgaaagaatcgtttgagcgggccaaatcagaagcgaaagccgcattcggaaatgatgaagtgtatgttgaaaaactgatcgaaaatcctaagcatattgaagttcaggtgatcggagataaagaaggcaatgtcgtccatctgtatgagcgggactgttccgttcagagacgccatcaaaaggtcattgaagtggcgccgagtgtatctttgcagcctgaattaagggacgaaatctgtgaagcggctgtggcgcttgcgaaaaatgtcggctatatcaacgcggggaccgtggaatttctcgtagcgggcggtgaattttactttattgaagtgaacccgcgcgtacaagtggagcatacgattacggaaatgataacgggggttgatatcgttcagacgcagattctcgtcgcgcagggccacggactgcacagccgcgccgtcaatatcccagagcagaaagacatttttacaaacgggtatgcgatacaatcacgtgtgaccactgaagatccgctgaatgactttatgcctgacacgggtaaaattatggcttaccgctcaggcggcggtttcggcgtccgccttgatacgggaaacagcttccagggcgccgtcatcacaccttattatgattcactgctcgtcaagctgtcgacatgggcgctgacgtttgaacaggcatcagcgaaaatggtccgcaacctgcaggaattcaggatcaggggcattaagaccaatattccgtttcttgaaaacgtggcaaagcatgaaaaattcctgacgggccaatacgacacatcgtttatcgacacaacgcctgagctgtttgttttcccaaaacagaaggaccgcggaacaaaaatgctttcctatatcggcaatgtcacggtgaacggttttccgggaatcgggaaaaaagaaaaacctgcatttgataagcctcagaccgttacgttagatatcggggaaaagccggcaagcggtacgaaacagattcttgatgaaagaggcgccgagggacttgcagactgggtgaaagagcaaaaatccgtgctcctgaccgatacaacgttcagggatgcccatcagtccctgctcgcaacacggatcaggtccaacgatttgaaaaaaatcgcgaatcctacggctgccctgtggcctgaactgttcagccttgaaatgtggggaggcgcgacatttgatgtagcgtaccgtttcttaaaagaagacccttggaaacgccttgaagatctccgtaaggaagtgccgaacacattgttccagatgctccttcgttcatcaaatgccgtcggttatacaaactatcccgacaatgtcattcaaaaatttgtccggcagtcagcggagtccggtatcgacgtattccggatctttgacagcctgaactgggtaaaagggatgacgctggccatcgatgccgtccgtgaaaccggaaaagtggcggaggctgcgatttgttacacgggagatattcttgataagacccggacgaaatatgatttgcaatattatctttctatggcgaaagagcttgaggcgtctggtgcgcacattctcggcattaaagacatggccggtcttttgaaacctcaagccgcatacgaacttgtctcagcgctgaaggaaacgattgatattcccgttcatcttcatacgcatgatacgagcggcaatggcgtctttctctatgccaaagctgttgaagcgggtgtggacatcgtggatgtcgccgtcagctcaatggcgggtctgacttcacagccgagcgcaagcggattttatcatgcgcttgaaggaaacagccgccgtcctgaaatggatgtccggcaggtggaaagactgtcacaatattgggaatccgtccgtcagtattacagtgaatttgaaagcgggatgaagtctccgcatactgagatttataatcatgaaatgccgggcgggcagtacagcaatctgcagcagcaggcaaaaggagtcggcctgggcgatcgctggaatgaggtgaaagacatgtacagcgttgtcaaccgcatgttcggcgacgtcgtgaaagtaacaccttcttccaaagtcgtcggagatatggcgctttacatggtgcaaaacaatttaacagaacaagatgtttatgataaaggcgaaacgcttgattttccggattcagtcgttgagctctttaaagggcagatcggtcagccgcacggcggatttccggaaaaactgcaaaagctcgttctgaaaggacagacgccgatcacggtaagaccgggtgagctgcttgaaccggtatcttttgaaggcattaaagaagaatggaaagaaacgcatcagatggaattgagtgatcaggacgcaatcgcgtatgctctttatccgaaagtatttactgaatatgttaaaacggctgaacgcttcggtgatatttccgtattggacacaccgactttcttctacggcatgacactcggtgaagaaatcgaagtggaaatcgagcgcggaaaaacgctgatcgtgaagcttgtatctatcggtgaaccgcagccagatgcgacacgtgtcgtttatttcgaattgaacggccagccgcgcgaagtggtcattaaagatgaaagcattaaatcgtccgtacaggaaaaattaaaagcagatcggacaaacccaagccacattgcggcatccatgccgggaacggttattaaattgttaacggaaaccggggcaaaggtgaataaaggcgatcatctgatgattaatgaagcgatgaaaatggagacgacggtacaggcgccgttctccgggacaatacagcagattcatgtgaaaaacggtgaaccgattcagacaggcgatttactgatcgaaattgaaaaagcgtaaaaaataaacataaaaaacctgatccgccccgtgtgcgatcaggttttttatatgtgaaaaggccgaagctttgatgcttcggccttttcatgtgcctcagatgttccgctgttttgattcatagcggaagcgggcgattaataataagaaatagcataagacaccgaacagaccggcaataaagagcgaatgggcaagtgcaaagccggtggccatttctgaataaacaaccatgattccggagagcgcctgtaatacaacaaaggcaagagccgctatccagcccccaagaatctgtttttggtctttgtaggagcgcaccgcatgcgcaaaagcgacaagaatccatacgaacagaagcagcgctgccgttctgtggcccatctgcacccactcctgaaaatgagacggaagtccgtggttcagtctgctgcaaagcggaacgtcaggacaggcaaggcttgattttgtatggcgcacataagcccccgtataaacgacgatatacgtgtaaatcgaaaggccgatcatatgaaactgcattttcctgccgattctgagcggcttgacgagctttttgtctgatttatcagcttcaaatatgagcagcgtcaaaatcagaacagaagcgaaagaaatcagcgatatgccgaaatgaagcgccataacgagcgcatttgatccgaaaacaaccgctaatgcgccgagaagcgcctgtaaaaataaaaagataatggacataatggcgagaaaggttgtttcacggaaaacaggcgtgacttttctccatgcccaaaaagcgagactcagcacgagaacgattgagacaccgcttgcgagtctgtggctccattcaatgatagaagcggcgttaagctccgggaaaaaccggccgtggcaaagcggccactgccttccgcatccgagacccgatcctgtttttgtgacaagagcgccgccgatcagcacgacgagcataacgaacgtcgtcagcacgccgagcgctttcaaagctttattcattttacattcaccttcttaacaaactggacaaaatgatatacgtaccaagtgtaagcgaatatgtgttttgtggcaattctcaattctgtttgttcacaaaaatataatagaatcaggacttcttagataatggggttgattattccagatgggtctgatagaaataaagtaaccgctttattatgaagccggcggatttggtaaaattcataaaaagttcacaaataaattcctgtttctcgtttaatatttaagaggatgtttttttacaggtcattatcttgtatgatagagttgcaggtcttaaaaaacctgctttaggtttgtaagggaggtttacgttatggctaattccagaattttaaacgatacagctatagacggacagattgaagagacgacggcatggaaggatttcctttcgcttatcaaaataggaatcgtcaattcgaatttaattacgacttttaccggcatgtggcttgcgttacatatatccggtctgagttttttaggcaatttaaacaccgtgcttcttacattaataggatcttctttgatcatcgccggttcttgtgcggttaacaactattacgaccgtgatattgatcatttaatggaacgcacgaaagtaagaccgacggtaaccggaaagattcagccgaatcaagcgctgtggtcaggaattttactcattgctttaggacttatcatgcttttgatgaccaccgtgatggcagcagtcatcggttttatcggcgtgtttacgtacgttgttctttatacaatgtggacgaaacgccgttatacgattaatacggttgtcggaagtgtatcaggcgccgtgccgccgttaatcggctggacagcggttgaagggcacatcggtgttgtcgcgtgggttttattcatgattttattcatctggcagattccgcactttttagcgcttgcgattaaaaagacggaagattacagagcagcgaatattccgatgcttccggtagtgcacggctttgaagtgacgaaaagacagattatcgtctgggtcgcatgcctgctgccgcttccgtttttcctcggcagtctcggtcttccgatcgtcattctcggcactttgctgaatgtcggatggcttgttctcggactgatgggattccgcatgaaaaacatcatgaagtgggcaacccttatgtttgtctattcgcttaactacatgaccatttattttgtagcgatggtggtcttcacgctgttttaattgaataatgagcttgtttgatcgccaaaacaaacaatgacaactagtaaacgccgccttgaccttttgtttaatcaggcggctttgcttttatacatagatggaattttaagtaaaaaatctcatattttaagaaatgaggaaatgaagtatttcggctggaagcagatttactgcttgtgcatctcgtactgattcaaaaaaggggttgggtgaaatgttaaagcgttggcgtcttttatcattattagccttagtgccgcttttattgagcggctgtggaaaaccgtttctgtccacactcaagcctgccggcgaagtggctgataaacaatatgatctgacggtgctcagcacacttatcatggttgtcgtcgttgcggtcgtagcagttattttcttttacgtcattgtgagattcagacggtcgcgtataggggaagacacgataccgaaacaggtggaggggaaccgttttttagaaatcacctggaccgttattccgatcctgcttctgattattcttgtcattccggttgtcatcgatacattggcactggcggatacgtcgccgatggataagaaaaaccgtaaagcagaggatgcgctcgtgattaatgtaagggcgaatttatactggtgggaattcgagtatcccgattacgggtttgtgacaagtcaggagctgatcgttcccacagatgaacgcgtctatttcaagctgaagtcctcagatgtgaaacactctttctggattccgtcagccgggggaaaaatcgatacgaatacggataatgacaacactttctttctgaccttcgattctaaacgcagcaaagaagcgggagaatatttcttcgggaaatgcgcagagctgtgcggaccttcacatgcgctgatggatttcaaagtgaaaccgctgccgtcaaaagaatttaaacaatggacgaaagcgatgaaaaattataagcatacaacagattccgatttagcagcacaaggagaagagctgtttaaggaaaaaaactgcctgagctgtcatgcggttgagcccaatgataaacgggctgaagcggcaagaacggctccgaacctcgctaccttcggtgaacgggtcaaagtggccggcattaaggatgcgaataaagagaatataaaagcctggctgaaaaatccggacagcattaaaccgggcaataaaatgacaggcacttatccgaagctctcggacgctgaaacggatgcgctgtatgaatatttaaaagggctgaaagcggagaacaagtgaggacagggagatatcagggggaggtcgcaaatgatgaatacgcttacaggacagcaaagaaaaagctctttgctttgggattatttgacgacggttgaccataagaaaatcgcgattttatatatgatcgccgggggatttttcttcgtcgtcggcggacttgaggccatgcttatcaggattcagctcttgaggccggggaacgattttatgggtgctcagcagtttaatgaaattatgacgatgcacggcacgacaatgatcttcctggcggcaatgccgctgttattcgggctgatgaacgcggttgtgccgctgcagatcggggcgcgtgacgtatcattcccatttttgaatgcgctcggattttggctgtttttcttcggaggcatctttttgaatctgagctggtttttagggggcgctcctgatgcaggctggacgtcgtacgcgtcgcttgcgctgaattcgaaagggcacggcatagactttttcgtgctcggcctgcaaatatcaggcttaggtacgctcattgcggggatcaattttctcgccacgattattaatatgagggcgccgggtttaacgtatatgagactgccgctgtttacgtggacgacatttgtggcgtcggcactcattttattcgcatttcctccgctcaccgtcggtttggcgctgatgatgctggatcgtttgttcggaacgaatttctttaatcctgaattgggcggcaatacgataatctgggagcatctgttttggattttcgggcatccggaagtatacattttaattcttcccgcctttgggattttttcagaaatcattcccgtatttgcgaggaaacgtctgttcggttattcgtctatggtctttgcgatcgtgctgatcggctttctcgggttcatggtatgggttcaccacatgtttacaacgggactcggaccgatcgctaatgcgatatttgcggttgcgacgatggcgatcgcggtgcctaccggcattaaaattttcaactggcttttgaccatctggggaggaaacgtcaaattcacgacgcctatgctgtatgccgtcgcctttattccttctttcgtactcggaggagtcacgggtgtcatgctggcggccgcagcggcagattatcagttccacgatacgtattttgtcgtagcgcatttccactacgtcattatcggcggcgttgtgttcggcatcctggcgggcgtgcatttctggtggccgaaaatgttcgggaaggtgcttcatgaaacgatggggaaaatttcgttcgtcttattttttatcgggtttcatcttaccttcttcattcagcattttctcggcttgatgggaatgccgcgccgcgtttacacatatctgcccggccaggggcttgataccggcaacctgatcagttcaatcggcgcgtttttcatggcaggcgcggccgctttactcgtcgtcaatattatttatacctcaataaaggggaaatacgtcgggaacgacccgtggctggacggtcgtacgcttgaatgggcggtctcttcgccgccgccggaatataattttaaacagcttccgtttgtccggggacttgacccgctgtggattgaaaagcaggccggaaatgaagggatggcgcctgcagagcctgtagaggacattcatatgccgaacggctccatcatgccgtttatcatatctttcgggctgtttgtggcagcgttcgggtttttataccactccgattattcatgggggcttccggttatcttcatagggctcggcatcacattctttaccatgctgcttcgctctgtggtcgatgattacggctatcatattcacaaagaagatctgccgaatgatgataaaggggtgaaggcgtaatgcagctgcaggaaaaaatgacggctgaaacctttccggcttctcctgaaaaagcaacgctggaggggaaaaataagtttttgggattttggctgtttctcggcggcgaaacggttctgttcgcctcgctatttgcgacattccttgctttacgggaatctaaagccggagggccgtcaacggctgagatgtttgagctgccgatcgtgtttatcgcgacgatgcttcttttgacgagcagcttaacgagtgtgtatgcgatgtatcatatgaaaaatttctcctttaaaaaaatgcaggtgtggcttctggttaccgtattattgggagcgggatttttaggggttgaaatctatgaatttatgcattacactcacgagttcggatttaccattacaagctctgcgctcggctcagcgttttacacgctcgtcggcacacacggagcacacgtggcgttcgggctgttgtggatcagcgcgctcatgatccggaatgcgaaaagagggctcagcctttataatgcgccgaaatattatgtggccagcttatattggcattttatcgatgtcgtgtgggtctttatctttaccgttgtatatttgatggggatggtgggataacgatggacgataacaaaaacagagagactgtcagtacggatcttgaatatcggagaaggaaaaatgccgaggagatgaaatatcaggtcatctccttcggcttgatgatcggccttacgcttgtcgcgtttttgacggtggctgcagacggcattgccggatggtttacgatgccgtttctgatcctgcttgcggtcattcaggtcatctttcagctgttttactttatgcatatgagccagaaggggcatgaagcgccgtcattatttctgtattcgggaatatttgtcgcgtttatcaccgtgcttgcatttgtcacgattatttggtggtaatcggggcggcggggagtgagagatttgattaatttggaaatgttcgggtttcgcgcaatgtggagcccgtatctgttttgtataactgccgtgataacaggtgtttacttttactggtgcagccggcataaaggacgtgtggccgttaaggagaaggtgctgtttgtgctttccgcgctatttttttacgcggctgcgggaagtccggtcgatttattgggccatgtgatgttcagcgcccatatggcgcagatggcggttctgtttttagtcgtaccgccgctgttgatctccggaattcccggctgggcatggaaaaaactgatcttccgtcctgtcgtaaagccgctgttttcatttttttcaatgccgcttatcgctttagtgctgtttaacggtattttttcgctgtatcacatcccgtttatatttgatttcgtcaaaacggattcgctgtatcacacgctgatgaacggactcatctttgtaacggcgttttttatgtggtggccgcttgtgcataaggtggacggtctgccccgtctcagcggtttaatgaagctggggtatattatggcggacgggattttgttaacgccggcctgcgcgctcattatgttcagcggggcgcccatgtatgccacgtatacagatccggcggcttgggccgaagcaatgaagctttgcgttcctttagatttgctggaggagatccctttatccgggccggagatgtttaacacgctacctcctctggaagatcagcagcttggggcagtgctgatgaaaatcattcaagaggcggtctacggaatatatttggctgtcatcttttttcagtgggtcagaacggaacgggaaaaagatacgctgtcagagccgccgtatatcgagcataccgtctcataaaaaaaagtacagcagaatatgctgtacttttttattacatttgcactgtttttaatgactcttccaattcaagcagtaaagctttgctttcagcgatgacatgttccggaaattcttcagcgctgccgtattctacgccgtgcggataataatgctttcctaaaagaggggccttcagctgaatcacggcccgtctgccgccgacatcgccctcttttgccgttccttgaatccgcagataaaatgtccctcaggtactgaaaactttttgtcgtaagtcactctttcataatcccattgtccagccagaatgagccctttgccttccatcagatcgttcaagcggctgagctccgctgttaccccttcaagaccgctgttttcaaacttcaaaccttccccctccttttaaaaatgccctttcctgacaatcatagtatgaaagcgttacactttcaatgattcatacggtgaaagtatgcaaaaacaaaaatttgacgacaatagtagcagaaaaaaggaggaattccgcaatgacaaagatcaataagctcatgacgtcagacttgcaatattgtacagtattagataatgtatatgaagctgcggtgaagatgaaagacgcggatgtcggcgccattccgatagtggatgaagacggcgccacacttgtcgggatcgtgacagacagagatctcgtattacggggaattgcttcaaaaaagccgaactctcaaaaaataaccgacgcaatgacagagcgggttatcagtgcagaagaagacgcctctgtggaggaggtgctccatttgatggctgaacatcagctcagaagaattcccgtcacaagggataaaaaactggtcggcattgttacgctcggcgatctttcgttggccgagcaatcaaatgagcaagcaggccgggcgctgtctgacatttctgaagacggaggtccggaggggtttatccattaaacataaatcacggacgatgcaaataggctgtactgtataagagtacacaaaaacagaacggtttgatgatatggggtgagaggttgaaaaatattgcaagggctctcgttatccttttgcttatttacggagcgtatgttctgtttatacaatatggatcggctcctcagaaaaagaccaatcaggaggagcctcaggtttccaatgaagaagagagcggaaaacggctgaaaatgccgtcatccggactgctttctctcatggggaaatctgccgccgatgtgaaaaagaaacttggggaaccgtcccggaaagatccttctgcctacgattacgagtggtgggtgtacaaccaggggaaagaccaatacgtacaagtcggtattttgaatgataaagccgtgactttatacgcttcgggaagcggcatcaacgcaaaaccgtttaagatcggcgaatcgacgggcgaagtttttaaaacgacgcaggtttctccttttgtcaatgtgactgacaagggaaacacgtatcggtttgagttttccgaagaagatatcaatacccgtcccaccgtcaagataggcggaatgtatgttcagctgtacatggacaaatttgacgggaatctgtcaagcatcagggcttttgatgcggaaacgctggtgaaacaaaggccgtatgaggtcatgtacagaggaaagctgacagaacccgagccagtttctgataaaaaatggaacgacattgaacgagcgagtgaacagcagattctcgacattacaaatgtcatccgcgtgaaacacggactggcaaggctgaaatgggacgaaggcgccgcgaaagtggcattcggccacagcaaggacatgaaggataacaagtatttctctcacgtctcaaagaaatacgggactctgaaggaccgcttggaaaaaggcgatgtgaaataccgggaggccggtgaaaatattgcctacaactatgtggacggtcctgcagccgtggagggctggctgaacagcgaaggccacaggaaggcgctgttaagcccggattatacgcacctcggtgtcggcgtggaccggaagtattatacgcaaaacttcattaagccttggcagtaaaaaaccgcagaggggcgcgtcccccgcggtttttttatgatttttcgcgagcggcgctcctgctgaaaaaaatatacctgctttttttcgcaatttaggcgaacattaaggcgcatgaaccgatacattatagcaggcaaaacttttcggagggggtgagaattgtggcgaatcagcaatcacggcaatcaatcgatgattttaaacaattcgtaaaaaagcatcccaaactgatccaaaatgttcgcaaggaacaaagaagctggcaggaagtctatgaaaactgggttctcctgggcgaggatgattcgatgtgggacccttttaaagacgaggccgttcagccttcttccgacgcggaaaccaaacaggaaccagctgaaaagaacgatttcgtttcaaaaatggtcactgccgtcaaaaagatggatatcaaccaaatgaatgagcagatcaataaaatgagccagtccatttcatcattgcaaagccttttaagccaattttcggggagcagcacgaagcagccccggcaaggctccggacaacatcctttttcattcagaaaggattaaagaaggggatcgtgtatgcgaaaagaggttcaggaattcatatccgcagatgaggaacggaaacggtttatacggcagcgtcccgtctggtaccgcagacttgcgagaaaaccggacgatctcaattcctttcagcttgacatgatgaatttttatgaaaagacgataccgcatcgggtaagtcaattctcaaacgggattcaaatggcgcagatgatgatgcagatggtacacgccatgcgttcgcaggattaaaaagcgtttaaacgccgcattttccaattgggtggtttcatggtaaactagcaactggaggtgcgtatttatgtatgcaacaattgagtccgtcaagcttcaaagtgaagcggaacagcttgccggcatgattctgcagtctgagacggctgaaaattaccgcgattgttacaagcgtctccgtgaagatgaagaggcagggcggatcattcgttcttttatgagcgttaaagagcagtatgaggatgtgcagcgctttggcaaataccatcctgattatagagagatttcccgcaaaatgagagaaatgaagcgggagctcgatttaaacgataaggtggccgaatttaaaaaagcggagactgagcttcagtcgctgcttgacgagatcagcattgaactcggaacggccgtctcggagcatgtaaaagtgccgacggggaatccttattttgacggcctgtcatcctgcggcggcggctgcggttccggcggcggctgcggatgcaaagtttcctgacgagacggccgtctcgtcttttacataaaatgaacagaaagtcaggcgggtgatcatgatggaaaataagcgccaaggcataatcgtatatctgcattctttaaaacacagcaaaatgctgagaaaattcggcaacgttcattatgtttccaagcggctgaaatacgttgtgctgtattgcgatatggacctgatcgaaaaaacaatggaaaagatttcttcttattcttatgtgaagaaggtagagccttcttataaaccttttttaaagctggaatttgaatcaaagcttgataaagcgaaagagtacgattataaagtcggtatataaaaaaatccccgcagatacctgcggggtccttctattccttaacaagttaaggagaaggaaaagggagaggagaaaccggaggaagaacttatggggaaacgtaagtcttctccgcggttggcaacaacatcattcattgatgctgttacacgtagtcttgacaggaatgtgaatatgtatacacgtttttcacgttcattgtttgaaagaatgctttatgataagatagggattgtttttatacataacggctcagccgatgagaaacatcaaagttttcagaaaaagtggtgtgaataatgagagtaatttccggttcaagaaaaggacgagccttaaaggcggtgccgggcacatcaacaaggccgacgacggataaagtaaaagagtctatttttaatatgatcggcccgtattttgacggaggaacagggctggatttgtttgcggggagcggcggcctcgggattgaagcgctgtcgcgcggatttgaccgctgtatctttgtggatcgtgatttcaaagccatccaaacggtaaaagcgaatatcaaagcgctcgatctgctgtcttcatcggaagtataccgcaatgatgcagagcgggccctctatgccgcggcgaaacgggaaaaaggttttgacggaattttcttagatcctccgtataaggaacaaaagctgaaagcgcttatcgaaatgattgatgagcagaacatgctgaatgaagacggttttgtcgtagccgagcatgataaagccgttgtgcttcctgaagccgtcggcgcgctttctgtaacaagaagggaaatttacgggcttacaggagtgacgatataccgaaatagggggtaatgatgtggcaagtatagctgtatgtcccggaagttttgatcccgtcacctacggacacctggacattatcagacggggggcaaacgtgtttgagcaggtgtacgtatgcgtgctcaataattcttctaagcagccgctgtttacagtcgaggaacgctgtgagctgttaagagaagtgacaaaagacattccgaatattacggtcgagacgtcacagggactgttaatcgactatgcgaaaaaaaagcgggcgaaggcgattatcagggggctcagagctgtttctgacttcgaatatgagatgcaggggacttccgtcaaccgcgtgcttgacgaatcaatagaaactttttttatgatgacgaacaatcagtactcttttttaagttcaagcatcgtaaaagaagtcgcaaaatataacgggcctgtttcagagtttgttcctccggaagttgaacaggcgctgaagcagaaatttaaaggatgagaagcgctgatcggcgtctcatcctttttttgtccgtgctgacagcctgtaacaataaatcaatgcgtatacggcgagagctgtcagcgtgatggcgggcccggtttcaacaagtgtattccatccgctgacggcagcagatcccgcgtcctgatcgcggaaagggaggaatacggactggtaaggttcgtccaatgcaaggtaaagcggcttccacagtaagagaataaagagtgcggcataaatgccctgaaggatacgcgccgcgaaaaacggtttaaagcggatatctgtttccgataaaatgccggctacctgggcctgtacggaaaggccgctgaacccgagaataaaactcacaatcatggctttcggcagcaaggcggcatcagcttcactgaccagcttgctcccaagtgtaatttcaaacattccgctgataagagggatgtccagatttgccggaagatgaaaaagggaaagcagcgcgtttgtaaatacagaaagcacatccatgacttgtacgattgataataaccggctgaaaaccgaaaacaatataataaaaccgcccaccatcagcaaggtttgtacagaagaggtgacggcgtcgcccaaaatttttccgagcggccgcttttccgaaagccgcgccttgtggagggccagaaatgcttccttcagagaagggagagcgatcgtctttttaccggtatacgccgcttcttctttccgtccgtatgaacgcatcgtcaggccgacggcgatgtttccaagatagtgagccgatgccagcagaatgccgagagacgcgttatgaaaaaagccgaccgccacggcagcgaatataaataacggattggatgaattggtaaaagagacgaggcgttcagcctctactctggagatttgtttatcctggcgcagccgtgcagtcagcttcgcgccggccggattgcctgaagccatgcccatagccagtacaaatccgccgacccccggcactctgaaaatgggacgcataaagggttcgagtaaaaggccgacaaatttgacaatgccgaatccgattaaaagctcagatagaataaaaaacggaagcaatgaaggaaaaacgacctcccaccacatggaaagaccggttttggaggcttcgaatgaggcctgagggtgtgaaataaccgtcgccgtcaaaaaaatgaaaaacaatgaaatcaaaaatgtatgaaacttagacaaattcattcttacctccccgatgctaaaattgcacactgacatttatatcatgataaaatatagaacagaccttaaaggcggccgggcaagtacctatttgtcatcctgtactaatatacgagcataggggttcaatttagaccatagaattcatgtataggatgtctattagggggttcgtcgcgttggccaaacctacaatcgggttagcgttaggttcgggaggggcaagaggcatcgctcatctcggagtgttatccagtttacataagcatcagattccaattgatatgattgccggcagcagcatgggagcattagtcgggagcttttatgcggccgggcatgacgtggctacgatgaaaaaagtcgccaaagcatttaagcggcggctgtatgcggattatacgatgccgaggctcggatttttaaaaggagaccgcatcaggcagctcgttcatgcctatacgtacggcaagccgatagaagaactgcggatcccgctcggcatcgtggcctgcgaccttcagaccggcgaaaaactcgtttttacgaaaggttcagtatccgaagccgtccgcgcgagcatcagcataccgggcgttttcgtcccgcaaaaaatgaacggacgtatgttagtcgacggcgcggtggtcgacagaataccggtgtccgccgtaaaagacatgggtgctgatatcgtcatcgcctctgacgtatcccgggtgaaaaaaacggaaaaagcggcacatatttttgatgtaatcatgcaaagtatggatatactgcaaaatgaattggtccgtcaccagaccattgccgcagacgtcatgatccgcccttctcttgaatcattcagctcaagttcttttgccaacattgatcatatgatcacagcgggcgaagaagccgcagaccggatgatcggccggattaaacaagaaatagagaactgggagggctaactcatatgaaagcaaaacattttcgctgggtgtttatcatcctgatcttattaattgctgttacatttattaagcttccgtattacattacacagccgggagaagcatcagagctgagaccgctgattaaggtggacggaggctatcctgaaaaaggaagcctttccttgatgactgtcaaagtaggccccgccaatccgtatacatatctttgggcgaaagtgcatccttacgatgaaatcgtccctgatgaaagcataaaagaagagggcgaatcggactcggattatatgaagcgccagctgcaaatgatgaaaagctcccaagaaaacgcggtcattgccgcttatcaaaaagccgggaaacaggtgaaatactcatttaacgggattttcgccagctcagtcgtctctgacatgccggcaaaaggaaaaatagaggtcggtgataaaatcatcagcgcggacgggaaaacatacgaatccgctgaaaagctgattgattatatcagcagcaaaaaagcgggggagaaagtaacgtttcacattgaacgggacacgaaagaaaagaccgttgacattgcgctgaaatcattcccggacgacccgaaaagagcgggaatcggcgtcgcgttatatacggatcggaacgtgaaagtaaagccggatctccatttcagcattgaaaatatcggcgggccttctgcgggtctcatgatgtctttagaaatttacaaccagctgacaaaacctgacgaaacaaaaggctataatatagccggaacggggacaatcgacgtggacggcaaggtcggaccgatcggcggaatcgatcagaaagtcgtcgccgcagacaaagcgggaaaagatattttctttgcgccgaatcaaaacggagctgaaaattctgattacaaaaatgcggtaaaaacggcgaaagcaatcaagtccgatatgaagatcgtccctgtcgacaccatgcaggacgcacttgactatttggatcatctgaaagtaaaaagcacctgatacaggcaggtgctttttttacgcattcaaaaaacgctgttcgtcttcatcatagcggatcggcgcttgtgaaaattcctgtttctcaaaaaatgtgcgttcaggttcttttatcggcaggctgtaaacccgtcccgccagtatgtccagatccagagcgggatgagagaaagaagagagcttgctgacgagaggtgcggtaagctcttttttctttgccgacaggtacgcctgtccttttttcgtcattccgagaagacggatataaggagcgcttgaaggctgtaagagccgatgcatgtcctcctttttcgtccgtgtcagaatgtgcgtgttcatccgctgcagcctcgtccacgtgtatcgttttgttttcaatcgttccatcatttcgcgataggatcgggcttgtctgatggtgcgcagaattctgtgctcaaggccttcttccacttcatagattcggctcaattcttcagcggacagagtgctgaggctgtattttacatatgaaaaatagtcttcggtgctgtgccatatcccgtatgaatttctgtatgcctccagctcacgcgcagacgcttccgggagaaagctccttgcggccgccgttcctttttctatcagcgctttccggatgcttgttgcgctggctatccggctgttatctccgggaagctcggcgtcatgatactgggaagcgattctggctgtcgtataaggcttcatagcggaaccgaaggcgtgtatcgctctaacgtagtgaaaaccgagaatattgttcggcttggacaaatcgagcatgtcccgccctttgaatatgtgtgaaaaagcttttgaggcggcggccggatagctgagaccctttttcagctcctctttcagaatcaggctgcagtcatcttcctttcggctgaacgcttcagacgcttcaataaagggttcgatccgcccgttttcgctgccgaaaaacaagctgctgcatcctaaatgatgaagaagcgaaacgctgccgcgcgcgaataattccgctttttgtacggcatacatataagggagctcaatgacgatatccacgccgttttccagcgccatttttgtccgggcccactttgagacggcggccggttctccgcgctgcaaaaaagggccgctcatcaccgccgccgcgacgctgctgtccgttttgatttttgcttgttccgcatgatagcggtgtccgttatgaaagggattatattcaacaaccaggccgactgctttcatatttgtcccgcctttcttgctatgttttgcttcgtgtggtacatttgcaaatgaagtgcatattttagtccgtttcgtttagtgtatgcatagcctatccggctgtcaacgattgcatgacggcggcattatgctgtaaagaaaaaatattgacaaaaacattctgaaaagctataatcatgtttgttgctttcctgaggtgatacaaatgaaatggacgatttatcagcttcatcaaatggcgaaaaagagctttgaatttgatgaaacagttgagttaaatgagctgacaaaattgaattctgacatccgccgcatttctcccgtccgggtgaagggccgcgcggagattgaatccaagcaagtttcgtttgactttacgatttcaggcgaaatggttttgccgtgctcaagaactttagttgatgtgccgtatccatttacaatcgcgacaaaagaactgtttagatttcataagtcggatgatatagaagatgaggacgttcatattgctgaagacgatatcgtcgacttaactccgatcgtaaaagaagagattcttttagaaattcctatgcaagtcttttgtgaaactgaacaaaaagaaggagccgctccccaagtggggaaggattggcaagtgatttctgaggaagacaagaaaaatcaaatcgaccccagacttgcggatctgaaaaagctcttaacacaagatgatgaatcttaactctttaaggaggtgggaataatggctgtaccttttagaagaacttctaaaatgaaaaaaagattgcgccgtacacatttcaaactaaatgtacctggtatgacagaatgcccgtcatgcggagagatgaaattgtctcaccgtgtatgtaaagcatgcggatcatacaacggcaaagacataaatgttaaaagcaattaatgtatgaagaaaagcgcgggaatctcggttcctgcgcttttctttttttttgcccctccggcctgcttccgccgaaaaaattgtgagcgccagtagtctatctaatctatcagcggcatatgtatgaggtaaatgagcaaatatggagggagatacgattgacgataacgagacaagacgcgtggacgcaagatgaagatttgctgctggccgaagtggtgctcaggcatattcgggaaggcgggacccagctttccgcttttgaagaagtcggcagagcgctgacgagaacggctgccgcctgcgggttcagatggaattcttatgtcagaaaacaatatcagtcagggatagaactggcgaaaaaacagcggaaggaattaagaaagcagatcggggtgcattccgccaatctgccgggaaccgtcaaacagcctccgatccgcagggcggaaggagaaaaagagctgtccattgatgatgtcattttgtttcttcagcaatttaaagagtcgccggccgcagcggatgtgcgtcatgaaaaagaaaaactcacagaacagctgaccgcgctgcaaaaagaagtcgaggatctgcgtgaggaaaatgaaagcttgagaaacaagctggagatgacggaagaagattataaagcgttaattgacattatggacagagcgagaaggatggtcaattcaaaagaagacgacaggaaatcggcgcagagcctgtaaaatgaaccggcctgagggcggcggcccggccggttttttattatgccgtttctccggatgtcatttcaccgtccatatcgggatgccagatgtaaggattttctcctttatcacgcgccatatcatatttaacgggctcaaaattcatcttatcccagaattctgctgatttcatgcgtgaatttgtcctgatcggcattctgaaggattttgcaaaatcaacaagcgcttttccgtatccgttgttttgatagcccggaagaacctcaagcttccaaagttccaaaaagtcctgacgctgatcaaaatacggattcgcgcctccgtttacctgatataaactcattctcgccactagtttatccccgaagtaaatcccgtaaaaaggcgaggtgctgtcattttcaatgatattatcctgaagatcttcaagcatcgacagctcctgcatcccgtattccttaaaccttttaaattcttcgagtgtcttaaagttgatgagcaggcgctctattttcaacacaaactccccctttgttgtgttctaccattattgtaaacgctttaattgaaaattccaactataatatgcttgcctgtctttttgctcaaaacgaaattgaagtaatttgcggcggcttctgctatgataatatggaaaaatgcagatatagggtgtgacagtgtgaaaatcggaattatcggcggcggagcggtaggccttttatgtgcttactacttatcgtcccgccatcaggtaacagtcattacgcggcggacggagcaggctgatgcgattaactcaggcggtatacggcttttgaaagacggaatagaatgtacggcggcatgcagagcgcaaacaggcatcacttccggattcgacctcttaatcgcagccgttaaacagcaccagctcagtgctgtgctgcgggatcttgagacggtaaaagggacgaatgtgctgtttttgcaaaacggcatgggacacatacacgacattagagattggcatacggatcattcgctttatgccggcacagttgagcacggagcaaaaaagatatcggatcatgccgttgaacatacgggagcgggagccgtaagatggagtgtattcagcgcatcccggccggaaacgctcaaaagcatcttttccggcatgcaccgggattttcccgtatatgatgaaaacgactggtatcggcttttaacgggaaaactgatcatcaatgtatgcatcaacccgttaactgcattgctgcgcgtgaaaaacggagagctgttaagaaatgacgcttacaaaaaatatatgagaaacgtgtttgaagaagcggagacaatacttggcctcgccgatagagaaaaagcgtggaacaaggtttgcgaagtttgcagactgacggaaaaaaatcattcttccatgctcgtcgatatcatggcaggcaggcggaccgaggccgatgcgattatcggctaccttgtaaaagaagcggaaagccgcggattgccggccgttcatctcacgtttttacaccgcagcataaaagcgttagaaagaaattgaaacaaagtcttttgaggttttccggtaacatgctatactcatttcggaaacctaactatttattggagaaaggaagttccagacagatgcagctaactgaactttccatcaaaagtcaaaataagtttgtgcagcactatatagatggagaaaacatgtcttcattttttgattatgatattcattcagaggacgtatggcaaaagcggcttcatgacctctcttcgcggccgtttgccagagaggaattagcggattatttatcctcctatcacgaaaaatttcactccgccgccatgcaggcctccatcgaaaaactgagagatccaaaaagcgcagcggttgtaggcggccagcaggccggtcttttaacggggcctctttacaccatacataaaattatctccattatcgtacttgccagacagcaggaagaggcgctgcagattcctgtcgctccgattttctgggtggcgggtgaagatcacgatctggaagaaattaattatgtgcatacgtcaacagagaataaaggtccggtgaagcggaaactgccgcagtcgtactggaaaaaaacatcggcggctaaaaccgagcttgatcaggaaaaatgcgcggcttggattgatgaagtgttcgctgcttttgaggaaacggatcacacaaacacactccttcaaaacgtgaagcgatgtttacgctcatcagagacattcacggacttttttgagctgttgatcgccgacttgtttcaagaagaaggccttattctgatgaattcgggagatccggggattaaaaagctggaaacgggtatgtttcagcagattttaaaacacaatcacgagcttgtcaaagccgtgtcagaccagcagcgtcttatgcgggaagccggttatcacccgattattgaatcggacaaagatcaggctaatctgttttacgaacacgagggagagcgtttcttaattgaaaaagaaaacggcgtttttgtcattaaggagcttgacctgaagtggacgaacgacgagcttcatacccatatggaagaaaaaccggaatgtttcagcaataacgttgtgacaaggccgcttatgcaggagtttctcatcccgactctggcgtttatcgcgggaccgggggagatcaattattggggtgagctgaagcaggctttctcattaatgggcttccgcatgacgccggtagtgccgagactgaacattacgattcttgagcgccatattgaaaagaagctttcagaacggaatattccgcttcaggaagcgatcgaacacggcaccggacacctgaaagacgcttattttgaagagcagattccggaagagttttcttctgtaatggaacaggcgaagtcgcagattgaagctgtccataaaagcgcaaggaacgaagcgctgaaggtcgattcaagccttgagccgctcttacagaagaatgccgccttcattcaggatcagctcttgtttttagaacggacggtaacgaaaagaattgaagaaaaagaaggttttgtgctgcgtgactatgaaagaatccaaaacagcatcagaccgctcggcgctccgcaggaacggatttggaatgtaatgtattatttgaaccgttatggtccaaaattcttcacaaccttcaaacatctgccattttcttttcaaaaccaacatcagattgtcaaactttgaaataaagttttaaagaaccctgaatagttcagggtttttttttatgtgtaaacagtgtaaaatgaggttgtggagagaagtggcggatagtggtgagtttaggggagaaagtggggtccttatcatgtttatgggtgaataccagcatacaattgatgcaaagggccgcatgatcgtacccgcaaaattcagagaaggcctcggtgagcagtttgtgctgacaagaggacttgaccaatgccttttcggctatccgatgaatgaatggaagctgattgaagaaaagctgaaggctctgccgctcaccaaaaaagacgcccgcgcatttacccgattctttttttccggtgcgaccgaatgcgaactggacaagcagggaagggttaatattgcgtcatctcttctgaattacgcaaaactggaaaaagaatgtgttgtcatcggggtttccaatcgaattgaattgtggagtaaggtaatatgggaacaatacacagaagagcaagaagattcattcgctgaaattgctgaaaacatgattggatttgatatataatggatcttcgtgcatcacaacaacaactgacaattcaattcattcctgataaaggtgggaccgacacaaatgtttcagcataagacagtacttcttcgtgaaaccgtcgacggtttaaatatcaaaccggacggaacctatgtggactgcacccttggcggcgccgggcacagtacatatttattgcagcaattatcggaaaaaggacgcctgatcgcctttgaccaagatgacacggcgcttgaaaacgcacagaaaacattgtccgaatacaaaggacagctcattctggtaaaaagcaactttcgttatttaaaagagtgtttacatgaacacggcattacgagtgtcgacggaattttatttgatttaggagtatcctctccgcagcttgatacaccggaacggggattcagttatcatcatgacgcaccgctggacatgaggatggaccagtcggccgcccttacggcgaaagaagtcgtaaatgaatggcggtatgaggaccttgtgaggattttctttaaatacggagaagaaaaattcagcaagcagatcgcccggaaaattgaagaggcaagagaaaaatcgcctattcaaacaaccggccaactggtcgatctaataaaggacgcgataccggctccggcgagaagaagcggaggtcatccggccaaacgtgtattccaagccattcgaattgccgtaaacgacgagcttcaggtatttgaagaggccctcttgcaagcgatagaggtgctgaagccgggcggaagggtgtctgtgatcacttttcactcgctggaagacagaatgtgcaagacgacattcaaggaaaaatcatcacttcccgaactgcctccgggtcttcccgtgataccggaagaatttgaaccggaattaaaactgattacgagaaagcccattacggcatcaaaagaggagcttgaagaaaataaccgcgcccggtcagcgaagctccgcattgcggagaaacgaaaataacgggcagcaaatgacaacattaaaggaggtcatcagcctatgagcaacttagcttaccagcaggaaaaacaacaacggccagtgataagtcccgaaaaaaaggtgattgtcaaaaagagggcttccattacactcggggaaaaggtgctgctcgtcctgtttgccattgccgttctctccacatcaatgtttatcgtatcaaaggcatacgcggcgtaccaatccaatattgaggtgcaaaaactggaggagaaagtatctgagaagaataagcagatcggtgatctcgaaaagacggctgctgacttaagccagccgcagcgcctgatggatatcgctaaaaagcacggtttgaatctgaaagataaaaaagtgaaaaacatacaggaatgataacccatgccgaaaaaaaataagtttatgaacagaggagcagcgatactcagtatttgtttcgctctctttttctttgtcattctcgggagaatggcgtacattcaattaaccggtaaagcaaacggagtagaacttgcaacaaaagcgaccgagcagcacgaaaaaaagcggacgatagaagcgagccgcggctctattcttgaccggaacggcaaagtgcttgcagaggacacggcgacatataagctcattgccgtgcttgataaaaaaatgacgagtgatccgaagcatcctcagcatgtcaaagacaaagagaaaacggcggaaaaactggcgaccgttatcaatcttgataaaagcgagattctggacatcttaaacaggaatggcgcgaagcaggtggaattcggttcagccggccgcgatatctcttatgcgaaaaaacaaaagatcgaaaaaatggatcttccgggtatttctttcttaagagatacgaagcgctactatccgaacggcatatttttgtcaaatgttctcggctatgccgatgtgaatgaaaaaacaaacgagatacaaggctctttaggacttgaaaaaatactgaataactatctgacggaacgtgacgggtccgtcacttacgaaagtgataaatccggctggaaacttccgaacagcaaagaaaaaatcaccgcacctaaaaacggtgacaatgtatatttaaccattgatcagaaaattcaaacctttctagaagacagcatgacgaaagtagcggaaaaatataaaccgaaaaaaattatggcggctgtcgtagaaccgaaaacaggcaaagtgcttgcgatggggcagcgtccgagttttgacccgaatatcagaaacgtcaccaattattacaacgacttagtgtcgtacgcgtatgaaccgggttcaacgatgaagatctttacgcttgccgcggcgattcaggaaaatgtgttttccgcaaacgagaaatataaatcaggaacatataaagtgggaggcaaacctgttaaagattggaacgatggcgccggatggggtatgacaagcttccatgacggcctcatgaggtcatcgaatgttgctttcgccaaactggccaacgaaaaactggggtttgaccggtttaatgagtacctgcacaaattcgggctctatcaaaaaacagggattgatctgcccggtgaagtatcaagtaaaattaactacaaatatgattttgacaaagcgtctacggcttacggccaagcatcggcgataacaccgatccagcagcttcaggccgtcacggcgattgccaataacggcaaaatgatgaaaccttacgtcattgatcatattgtcgaccccgatacgaaaaaagtcgtcaagcagacaaaaccggagcaagttggcacgccgatttcagccgatacggcgaaaaaagtccggaacctgctcggagaagtcgtgacgtcagacatcggaacgggaaaaccttataaaattgaaggttttgacgtcgcgggtaaaacgggaaccgcacaaatcgccgggacaggcggatatttaaggggaacgagcaactatgtgttttcattcatgggcatggcgccgaaaaatgatcctaagctcgtcatctatgtagccgtgcagcagccgcagttaaaagcgggtcaaagcagctctgatcctgtcgcggaaatctttaacccgacgatgaaaaacagcctccactacatgaatatcgaaccgacggaaaaaacagattccggtcaggaagaaacgaaaagccaaaagatgcctgacctgacagataagacagtcacgggcgctgagaaggaagcgaaaaatgaacatctcacaccgattgtcatcggcagcgatgttgccgtaaaagagcagtatccgacagccggagaagatgtgatcaccaatcagaaaatcttcttaaaaacagacggaaagatgacgatgccggatatgtccggatggtcgagacgggaagtgcttcaattcagcaaagtatcaggcattcacatcgatgtgagcggtgaaggttacgcttcaagccaaagtgtgaaaaaaggcaaagaactgaaagaaaataccgtgatcaaggtgaaatttaaaaatcctgattaacgggacagagaagtccgcggatgcccgcgggcttcttttttatgcgccgccgttctatgtgtccaagctgaggcataaattgaaacaagcctaaataaggagtggacggtcccttgcgcgtttcaaatgtaacggttcgaaaacgtttattactggttttgctttttggcgtaatcatttttttgatcattgacagcagattaggctatgtccaatttgtgatgggagaaaagctgacttcactggctaaggattcctggagccggaatttgccgtttgagcctgagcggggagaaatccttgaccgaaacggcgtgaagctggctacgaataaaagcgcgccgaccgtctttgtcgtaccgcgccagattcaaaatcccataaaaacgggcaagcttctcgcgtcagttttaaatatgtcggaagagaaggtctacaaacacattactaagaaaacctccatagaaaaaatctcacccgaggggcggaaaatttccaataaaaaagcgaaagaaatcaaagcgctcgacttaaaaggggtttatgtggctgaagacagcatccgccattatccgtacggaagctttttgtcccatgttctcggttttgcgggtattgataaccagggccttctcggattggaggcttattatgatgatgacttaaaaggtgtaaagggatcagtgaaattttatacggatgccaaggggaagaaaatgcctgatgaagcggatgattacacccctccgaaagacggacttgatatgaaattgacgattgacgccaaggttcagacgattatagaaagagagctcgataatgcagcggcgaaatataatccggacggaatgattgcggtcgcaatgaatccgaaaaacggggaagtgctcggtatgtcaagccgtcctgattttgatccggctgactatcaatccgtagatccgtccgtttacaaccggaacctgccggtatggagcacatatgaaccgggttcgacctttaagattattacgcttgcggcggctctccaagagcaaaaagtaaacttgcaaagagaccacttttatgacaaaggatttgccgaggttgacggcgcccgcctccgatgctggaaaaagggcggtcacggttcgcaatcttatcttgaagtcgttcaaaattcctgcaaccccgggtttgtacagctgggggaacggctcggaaaacaaaagctgtttcaatatattaaggacttcggctttggaaagaaaacaggcattgatctgcaaggggaaggaacggggattttattcccgcttgacagagtcggcccggtcgaacaggcgacaaccgctttcggacaaggggtttccgtcacgccgattcagcaggtggcagccgtttccgcagcaataaacggcggaacgctttatactccgtttatcgccaaagagtgggttgatcccgttacgaaaaaaacagttaagaaacaatcgccgattgcgaaaaggcaagttatttcccaggaaacgtcaaagcagatcagatatgctttagaaagcgtcgtcgctcagggaacggggcggaatgccttcgtggaaggatatcgcgtcggcggaaaaacaggtaccgcacaaaaggtcaaagacggcaaatatctcgaaaacaaccatatcgtctcctttatcggttttgcgccggctgatgacccgagcctcgtcgtgtatgtcgcggttgataatccgaaaggcacgattcaattcgggggaaccgtcgccgcgccgattgtcggaaatatgatgagagacagtctgccggagctcggcgtgaaaccgcgaaaaaatcaaatcgagaaaaaatatcaatggaacgacacaaaaacaatagaggttccgaatgttgtagggatgtctgtctctgatcttgagtcgctgcttgtcaatttgaatattgactcctcaggaaaaggaagcaaaattgtgaaacaatcacctgcagccggaacgaaagtaaaagaaggctcaaagatccgtgtttacttgagtgaagaatgagtctttttgaggcagccgattgttttcggctgccttttatcataaagagaaaaaaagaagataacttttaagattaactggatgtatccttttatttacgctaaaatatgaactgtatgtttaaaagccattctgacttttataaacggttatcatgataaaagaatgaatagaatttctgagaggtttgatacaatgaaacttacaaagctgcttacatatttaatggccgaacctgttcaaaatgactttcatgaccctgacataacttcaattgagatggactccagggaagtgagaaaagggagtctttttgtgtgtataaaagggtatacggtagacggacatgatttcgcccaaaaagccgcagaaaacggcgcagcggccatcgttgccgagaaagagcttgacgtcgatgttcctgtcattatcgtccgccggtcacagcgggcgctcagcgttctttctgacgcgttttacgggcagccgacaaagcagcttcagcttatcggcatcaccggcacaaacggcaaaacatcaacgacgcacatggttgatgagattttcaaaaaagcgggaagacagaccggtttaatcggaacgatgtacattaaaatcggggatgagacattcccggtcaaaaatacaacgcccgaaagcgtcacactgcaaaaaacgttcaagaaaatgaatgatgagcatgttgacacagctattatggaagtgtcttctcacgctctgtcactcggcagggttcacggctgcgattatgatatcgccgtattcacgaacctgacgcaggaccatttagactatcacaagacgatggaagactacagacaggctaaaagcctcctgttttcccagctgggcggctcctttaaccatgaaaagccgaagcgggccgttttaaacgcagatgacaaagccagtgcttattttgaaaaagtgacggcggcgcacatccttacatacggaatcgagaacgatgccgatgtcatggcgaaacaaatcgagatctctgcgcaaggcacaaattttgaactcgttacgccaaaaggaacaaagcagatcacggtttcactcgtcggccgcttcaacgtgtataacgtactggctgcagcggcgacagcgatcgcagcgggtctgccgtttgatacgatcacgagcgctcttgaagagctgcaaggtgtcagaggccggtttgaactggtgaatcataatcagccgtttcctgtggtcgtcgattacgcgcacacgcctgacagtctggaaaacgttctgaatacatgcaaagacatgacagagggcaagcttttcgtcgtcgtcggctgcggcggagaccgggataaaacgaaacgcccgaaaatggcggaaattgcggtgcggattgccgacgaaccgattttcacttcagataacccgagaagcgaggacccgctggccatattaagagatatggaaagaggggtagaaggcacctactatcacagtatcgcaaaccgcgagcaggctatcttttttgctattgccaacgcgaaaaagggagatgtggttctgattgccgggaaagggcatgaaacctatcagcagatcggcaatgaaacattcgactttgatgacgccgaagtagcgggaagagctattgttgagctgaataaaaagtaaaacaggaaagagtgttagaatgagtgaaatgaaaagaattacggggacacaatgtgaatatgataaatacgtatgtcgtttgaacgaaacgggaggagaaaagagcaatgcttgagcaagtgattttatttacaataataatgggatttttaatcagtgttctgatatctccgattcttatcccgtttttaagacgtttaaaattcggccaaagtatcagggaagaggggccgaaatcacatatgaaaaaatcagggacgccgacgatgggcggggtcatgattatcgtatccatcgctattacggcgattgtcatgacgcagaaattttcgcatctgagcgcggaaatgtttcttctgctgtttgttacgatcggatacggcctgctcggctttctggatgactatattaaagtagtaatgaaacggaatctcggattgacgtcgaagcagaaattgatcggccagatcattattgccattgtattttacggagtatatcattattgccatttttcaaccggcatcagggtgccgggcacacatctgtcaatcgatctcggctggggatactttatcctcgttctctttatgcttgtcggaggttcaaatgccgtcaacctgacagacggtctggacggtctcttgtccggtaccgcggctatcgcattcggcgctttcgccatccttgcgtggaaccagtcacaatatgacgttgcgattttctcggttgccgttgtcggcgccgttctcggttttcttgtattcaacgcccatcccgccaaagtatttatgggggataccggttcgcttgcgctcggaggagcgatcgtgaccgttgccattctgacgaagcttgaaattctgctcgtcattatcggcggagtttttgttattgagaccttatctgttatcttacaagtcatcagctttaaaacgacaggaaaacgaatctttaagatgagtccgcttcaccaccattacgaattggtcggatggtctgaatggagagttgtcgtcacattctggactgcgggactgctgcttgccgttttaggaatttacatcgaggtgtggttataagtggaaaacgaactttttttgcgaaaacaaaactttctggtcctcggactggcgaaaagcggatatgcggctgcgtcgattcttcatgaaaaaggcattaacgtcgtcgtgaatgatcaaaaagcctttgaagagaacgaacctgcccaaaggctttcagaaagaggaatcgaggtcatctgcggtgagcatccgacgtcactttttgatcagcatcacattaccattctgatcaaaaatcccggaatcccgtatgaaaatatcatggtggaggaagcgcaaagaagaggcatcccggtttggacggaaatcgagcttgcgtattatatcaccaatgcaaaattcatcggcattacaggttcaaacgggaaaacaacaacgacgaccctgatttatgaaatgctgaaagctgactcgataaaggcgctgatcgcaggaaatatcggcactgtcgccagtgaagtggcttatcatgctgacggtgatgaatggatcgtcacagagctttcttcgttccagcttatggggactcatgcgttcagacctgaaatcggcctgattttaaatgtgttcgacgctcatttggattaccatcacagccgtgaaaactatgaaaaagccaagcagaacgtgtatcttcatcagcttgagagtgatacggccatcgtgaatcaaagcgatgaaacagtcgtgcggcttgccgaaagcggaaaagccggcaccgttccgttttcagtgcaccaggaactgtcaagcggcgcatttattaaagacggaatgctgatgttcggcgatgaagcgattctgcctgttgatgacatcgtgctgccgggcgcgcacaatttagaaaatatattggccgctgtagccgcggcaaaaacggcgggcgcgtctaataaagcgattcagaaggtgctgacaagctttaccggtgtcaaacaccgtctgcagtatgtaacagcaatccggaatcgtaaattttataatgacagcaaagcgacgaatattttggccacaagcaaagcgctctccgcgttcaaagcaccggttattctgcttgcaggcggactggaccgcggcaacggttttgacgatctgaaaccgtatatggacaatgtcaaagcggtcctgacgttcggacagacagcgccgaagatagaaaaactgggcaatgagctgggaatacaacatgtcaaacgtgtcgataatgttgaacaagcagtatctgcggcgtttgcgctctcaaatgaaggagacgtcatcctcttgtcacccgcgtgtgcaagctgggatcagttcaaaacatttgaagaacgcggtgacatgtttatagatgccgtgcatatgcttaagtaagggcttgtctctgttcatcggcagccctaaatgacttatgcttggggtgtcgattgctttgactactaaaaaaacagcgcctgatttgttattagttatcattacgttattgcttttaacaataggattaattatggtctacagtgcaagtgcggtatgggcggattataaatttgacgactcgtttttcttcgcgaaacggcagctgctgtttgcggggatcggcgtcattgccatgtttttcattatgaatgtggattattggacatggcgcacatggtcgaagctgcttctgatcatttgtttttttctgcttgtgcttgtgctgattccgggagtcggaatggtgcggaacggttcaagaagctggatcggagtgggagcgttcagcattcagccttcggagtttatgaaactcgcgatgattgcgtttctggctaaatttctttctgaaaaacagaagaatattacgtcattcagacgcggattcgttcccgcgctcggaatcgtgttttctgcatttattattattatgtgccagccggacctgggaacggggacggtaatggtgggcacgtgcatcgtgatgatttttgtatccggtgcgcgaatcgctcattttgcgttcctcggactcatcggtttaagcggatttgcggcgcttgttctgtccgctccttatcggattaaacggattacctcttacttaaacccgtgggaggacccgcttggaagcggatttcagatcattcagtcgctctatgccgtaggtccggggggactgttcgggatggggctcggccaaagccggcaaaagtttttttacctgccggagccgcaaaccgatttcatttttgctattttatctgaggaactcggctttatcggcggttcgctcatattgctgctgttcagtattttattgtggcggggcgtcaggattgccctcggcgcgccggatttatacggaagctttgtcgccatcggtattatttctatgatagctattcaagtcatgattaatatcggcgttgtgacggggctgatcccggtaacaggaattacgctgccgtttttaagctacggaggctcatcactgacgctgatgctcgcagcggtcggcgtgcttttaaatgtcagccggtactcgaggtattgatctgtatcttgcctcatcactcatgatctattcgttatctataaaaaaacagacaacatcaataaccctgtcctaaaaaacagggttatcgctatgtgattaagggggacatacgaatgcgtattgcagtaagcggaggcggaaccggaggacatatttatccggccctggcctttattaaagaagttcagcgccggcatccggatgtggaatttttgtatatcggaacagagaacggtctggagaaaaaaattgttgaacgggaaaatatcccgttccgcgccattgaaattacaggtttcaaacgaaaactttcttttgaaaatgtaaaaaccgtcatgcgtttcttaaaaggcgtgaagaaaagcaaatcatatttaaaagagtttaaaccggatgccgttatcggtacaggcggctatgtatgcggtccggtcgtatacgcggcggcaaaaatgggaattccgacgatcattcatgagcaaaacagcctgcccggcatcacaaataagtttctctcgaaatatgttaataaggtggcaatttgctttgaagaagcaaaatcgcattttcctgctgaaaaagttgtgtttacgggaaacccgagagcctctgaagtcgtctcaattaagacaggccgctcattaactgagttcgggctgaaagacaatcaaaaaacggtgctcattttcggcggaagcagaggcgcggctcccattaaccgtgccgtgatagatatgcaggaagaattgaaaacgagaccttaccaagtgctttatattaccggggaagtgcattacgagaaggtaacggctgagctgaaaggcggaaaagccgctgataatatggtgacaaaaccgtttttgcaccaaatgccggagtacttacaatcaattgatgtcattgtggcaagagccggagcgacgacgattgcggagatcaccgctctcggcattccgagcgtgcttattccgagcccgtatgtgacagccaatcaccaggaagtcaatgcgaaggcgctcagccagcatgacgctgcaatcgtactgaaggaaaccgagctcagcggagaaaaactgatcgctgcgctggacaaaatcgtcatgaatgaagaaaccttaaaagacatgagtgagcggacaaaatcactcggtgttccggatgcggcagccagactgtacagtatcatggaagacataaaaaaatagagcaaatggaatgcggaggtttatgatggagaacgtaattcaggaattaagagaccgcgaagtcggcaaagtgctggaacaagaaccgctcgcgaaccatacaacgatgaaaatcggcggcccggcggacattttgatcatccccaacagtgtggaagcggtcaaagatattatggatattgtgaagaaacatgatctgccatggacggttatcggccggggttcaaatctgctcgtgcttgatgaaggcataagaggagttgtcatcaaactgggcgcgggtctggatcatttggagattgacggtgatcaggtgacggtcggaggcggctattcggtcgtccggcttgcgacttccatgagtaaaaaaggaatgtccggtctcgaatttgcagcgggcatccccggatcaatcggcggggccgtctatatgaatgccggggcgcacggatctgatatgagtgaaattcttgtgaaagcgcgtatcttatttgaagacggcacaatcgaatggctgacaaacgaagagatggatttcagctacagaacgtctgttttgcagaaaaaacgccccggcgtctgtctcgaggcagttcttcagcttgagcaaaaggaacgggaagccattacggcgcaaatgcagcagaacaaagattacagaaaaaatacgcagccgtattcaagcccatgcgccggaagcatattcagaaatccgctgccgaatcatgccggaaacctcgttgaaaaagcgggattaaaaggacatcagatcggcggagcgaaagtatccgaaatgcacgggaattttatcgtcaatgccggcggagcgactgccaaggacgttctcgacctgattgagtatgtgaaaaagacaatccgtgagcagtatgatgttgacatgcatacggaagttgaaatcatcggagggaatcgttaaaaggttctctgatttccatgagctcatgtgatatacttttaacaaatgtcaaacggcatcacagcatgccgtttgtttttcaatcagacgaatgtcaagctgtttcattcttagtgaggtggacaggcagtgaacccaaatcatgaaagagaaaaaatcgtaaatattgaagagcggattccgaaaatcaaagagcagcggaaacaaaaagcaaaccgccggctgatttcattcattgtgctcttttttatgatggtgctgatcatcgtgtacttgcagatgccgatcagcaaagtgtcttctgtcaccgtttccgggaacgaaaacgtgtctgtaaaagagatcaacgcgctttctgatatacataacggacaaaccgagttctggagtctgaacaagaaaaaaacagaagaaaagattgagcagaataaactggtgaaaaaggcggatctttcaaaagtatttcctaataaagtcagcattcacattgaagaatacaagacgatcgcgtatctgcagcggaatgatgtgtattatgaagtgctggagaacggcaccgtgctgccgaacgaagtcacgccggatgacgcgggcccgattttggttgactggacaaacgcgaaaaagcgggtcaaaatggcggagcagcttgataagctttccggttcgctaaagcagtcgatttctgaaatctattatacaccggtaaaaatggaccaggaccggatcaagctgtatatgaacgacgggtatgtagttaccgcttctattaaaacatttgccgaccggatgaagacctatccttctatcgtttcccagctggacggcgggaaaaaggggattatccacttagaagtcgctacgtattttgaagaatttaacaaaggtaaatccggcaagaaaaaagaaaatgattaatagttctaaagaactaattttaaggtgattcaaaagaatctattacaatcagcggggcagccgatataaccgatagcggaataattatgactatgtttgtttttgcccgggatatggctgccggacaaggggaaaattctcaatgcaatgggcgtgtcttcttcaatgaacattgcatttggaattttcctcctgtttcttcttttttcggatgtttctggcaatatctatagcttttctggaggttcatcttagtgtagactaatggaaagcgggtatatttgcatctggtttgcacattatggcaccgtgacaggaaatcttacggtaaggtgggccgtctctaaaaaaaataaaaaaaatgcgatataaaagaggatatacatagaatataacgaatagtttcattaaacataaattgtgagaaatcagataagaatttgttgatgctgttgtttttgttacacacttgtaaagccacattcattgtattgttgttccgcaaataatagaatagaatttgatcgaaatgtgaggaggtgccatagaatgaacaacaatgaactttacgtcagtcttgacatcggtacgtccaatacaaaagtgatcgtcggagaaatgacagatgattcccttaacattatcggagtgggaaatgtaccgtctgaagggttgaaaaaaggctcaatcgttgatatagatgaaaccgttcattctataagaaaagcgtttgaccaagctgaaagaatggtaggttttccgctgaaaaaagccattgtcggcgttaatggaaattatattcatattcaagatacgaacggcgttgtcgctgtttccagtgaaaacaaagaaattcacgttgaagacgtccgcagggtaatggaagcggcacaggttgtgtcggttccgcatgagcagctgatcgttgacgtcgttccgaaacagtttatcgttgacggaagagacgaaattaccgatccgaaaaaaatgctcggagtgcgcctggaagtagaaggcacgctgattaccggctccaaaacgatcttacataatttacttcgctgtgtggagagagcgggcgttgaaattactgatatctgcctgcagccgcttgcggccggttcggcggctttgtcaaaagacgaaaaaaacctcggagtcgccatgattgatatcggcggcggctcgacgacggtggcggtatttgaacaggggcacctgaaggagacagccgtcattccgctcggaggcgaaaacatcacgaaagatgtatcgatcggattgcgcacttccaccgaagaggctgaaagagtaaaaaaacaattcggacatgcattctacgatgaggcttcagaagatgaagtatttgaagtcaccgtcataggaacgaatcaaaagcaatcttttacacagcaggaaattgccaatattattgaagcaagagtggaagagattcttgagattgccgcagccgaaattgagcatatgggaattacagatctgcccggcggctttgtgctgaccggcggacaggccgcaatgcccggagtgctttcattggcacaggaagtgctgaggcacaatgtaagggtcgcaagcccgaattatatcggtgtaagagaccctcagtatatgacgggtgtcggcttgatacaatttgcctgccgaaatgccagaattcagggaagaaaaataggctttcatatgccggaagaagccgtgcaggaaatcgcggtctctcacgaagaagaacatcatcagcggccagaggcgcagcagcgtccaaaagcaaaacaaaaaacacaagccgaacacaacaaaccgagcaaaatgaaaaaactattaagcatgttttgggaatagattgatagtcattcggcagattaggaggatttagcatgttggatttcgaaacaaacatagacggcttagcatcaattaaagtaatcggagtaggaggcggcggtaataacgcggtcaaccgaatgattgaaaatgaagtgcagggtgtagagtacattgcggtaaacacggacgcgcaagctcttaacctgtcaaaagcggaagtgaaaatgcagatcggggaaaagctgacccgcggtctcggagcgggagcgaatcccgaagtcggcaaaaaagccgctgaagaaagtaaggaacaaatcgaagaagcgttaaaaggcgctgacatggtgttcgttacagccggaatgggaggcggtaccggaacgggagccgcaccggtgatcgcgcaaatcgcaaaggacttaggcgctttgactgtcggtgtcgtaacaagaccgtttacatttgaaggaagaaaacgccagctgcaggctgcaggcggtatcacggcaatgaaagaagccgttgacacactgatcgttattccgaatgaccgcattcttgaaattgtcgataaaaacacaccgatgcttgaagcattccgtgaagctgataacgtgcttcgccaaggggtgcaaggtatctctgacctcatcgcaacgcctggtttaatcaacttggactttgccgatgtcaaaaccatcatgtccaacaaaggttcagcattgatgggtatcgggatcgctacaggagaaagccgtgctgctgaagccgccaaaaaggcgatctccagtccgttactggaagcggcaatcgacggagcgcaaggtgttttgatgaacattacgggaggtacaaacctgagcctctacgaagtgcaggaagcagccgacatcgtcgcttctgcatctgaccctgatgtcaatatgattttcggttcagttatcaatgaaaatctaaaagatgaaatcgtcgtcaccgttattgcgaccggttttatcgaacaggaaaaagatgactcaaaaccgcagcgtccgactttaaaccaaggattgaagtctcaaagccaaaatgctgcgaaacgtgagccgaaacgagaagaaacacagcatcaaaacacggtgaaccgccatacatcacaaccggcggatgatgccctcgacattcctacatttttaagaaaccgcaacaaacgcggctgatgtaaaaaaggacaagaccacatggttttgtcctttttcttttttgtgcacagtcttccttcctatcccccatgatctatacagtgaaaaaagaagctttatacctatgacgaattgattgtttttaagtttcatacggctttctacagaatgtgacaatatctggatggaagattgtctacatttaacgtacagcatcgaaatgacaaacgattccaattatgaaggagggatacacattttatagggcgttaccaaataagggggatacgattgaagaaaaaaacgagaaacagatggacaggctccgttttaagcgcgattgtcgtcagttcactgttgtttccgggggcagtcggagcgaacagcacaccgggggcagtttcttttaccaaagatctttcttcctctaagagcattcagcataagatttccgattcagtcaagaagcgttttgaaaaaaatgataaagtcacgtttcttatcaaatttaaagagaaagccaatacgaaaaaagcggtcaaagaagcagaaaaaaatgccgagtctcattcgctttccgcagcaaaaaccgaatatcaaaagcggtcagccgttgtttcttctttaaaactggcagctcatgatgcgcagcagaatctgaaaacatatttggaaaaacaaaaaaagaaaggaaaggctgatcacatccattcctattatattgtcaacggaatggcagttactgcttcgaaagaggtaatggaaaaagccgcctcatttcctgaagtagaaaaagttcttccgaatgaaaaacgtcagcttactcaacggcaatcaaaagctccttttcaaatgaagaaaaaacaaaaagaggtcaaagcaaaggaaggcatcgaatggaatatcagccaaattgatgcgccgcaggcctgggcctcaggatacgacggaaccggcacggttgtcgcctccattgatacgggagttcagtgggatcatcccgcgcttaaggaaaaataccggggttacgatcctgaaaatccagcagcgccgaatcatgaaatgaactggtatgatgccgtgtcccataaagacgctccctacgacgatcttgaacacggcactcatgtaacagggaccatgacgggttcagaacctgacggctcaaatcaaatcggtgtggctccgggggcgaaatggatcgcagtaaaagcattttcagatgacggaggaaccgatgccgatattttggatgccggtgaatgggtgcttgcgcctaaagataaaaacggcacgccgcatcccgagatggcgccggatgttgtcaataattcctgggcgggcggttcgggaatggacgagtggtaccgcgatatggtgaatgcgtggagagcggcagggatttttccggaattctctgcgggaaatgaagacttatttacaccgggaggaccgggttcaatcgcaaatccggccaattatcctgaagcatttgcgacaggtgcgactgacatcgacaagaaactcgctgatttctcacttcaaggcccctcaccgtatcatgaaacaaaaccggacatttcggctccgggcgtgaatatccgttcttctattcctggaggaacatacgaaggcggctgggacggaacttcaatggccgggccgcatgtggcggcgacggcggctttgttaaggcaggcgaacgcctctattacggtcgatgaaatggaagacgttctgacgcgcaccgccgaaaagctgacagattccgtttttccggaatcaccgaataacggttacggccacggcctcgttaacgcttttgatgccgtttctgccgtaacggacggaatcggaagcgtagaaggcaaggtatcttctgcgggtgaagatcacaatccgcccagctttcatcatgaaccggtctcagaggcttacaaaggggcaaaccttccgttaacggttacagcagaagatgatgtaagcataactgaggtgatcctctcctatcagtttgatgaaggagagtggaaaacgacagccgccgttcaaaaaagcggtgatgaaaaaaagggaacataccaggcggagattccggacataacgggaagcaagataagttataaatggaccataaaagatttcggaggtcattctgtagaatctgatacgtaccgggctgacgtgaaaccgagcattacggcgggatacaaagaggattttgaatcacagccggcgggctggtccagttacgggacacatgatcaatgggaatggggtatcccgggttcagggcccggcgccgcattttccggagataaagtgtatgcgacgaatctgtccggcccttatgccgattcggccaacatgaatctcgtgatgcctccgattcaagttccggaaacagggcggctgtttttacaatttaaaagctggcacaagctcgaagaattttttgattacgggtatgtgttcgttctgccggaagggaaatcaaattgggagcaggcggccgtttacaatggtgattccgcaggatggaatgatgaagaggcggatttatctgcgtataaaggccaaaacataaagctcatgtttaatatgcagtctgacgaagtactcaatgaagacggatggtatatcgatgatatccggctttcaagcagccctctcggcaaggcggctaaaaaaagtaaacacaatagacaaacacctcccggccacctgaagaaaaaagccatcagtccgaaacaggccaaaccggcagtgaaatcacccggaaaaagagtgaaacgtgaaacaaacctcctgccgctcagagcgcaaatcagtgtcgccgagacggggaaatccgtatattccgaccctgcaagcggaagttacagcctgtcacataaggcgggaagctatacgctgaaagccgaggcttacggatttaagtccgcttcgaaacaagtttctattcaatcagacaaaaccgcacaggcagactttacactggagcaaatgccgtccggcacgctaaaaggaaccatcaccaatcagtccacaggcgaaccggtaaaaggggctgcgctttatgtggccgaggatgccgcaattgagccggcggtgacaaacgataaaggggaatattcgcttaaggcgtatgaaggctcctacacaatcaaagtagcggcaaaaggcttttacaatagcgaattttctgtcgacatcaaaggagatgctgaaaaaaacgtcaagcttaagccgtatgtcggttatgaaggggaaatcgcctatgataacgggacggaagaagccgcgctgtcatattttaaagccggcagcaaatctgccgttaagatgaccctcaaagacggaaaagaacacggtatgctgacgggaggcctttttaaattttggggcgccgactggcctgatccgggcggtaccgaatttcaagcagaagtatatgatgcatccggccctgatggagctccgggcagcaaaattgccggcccgttccaagctgaagcgcttcgaaacggcgagtggaccaaagtggatctcagctcaaaaggaatcgcggtcggaaaggatttttatcttgtgttccgtcagacgaaacccgatccttatacacctgccctgtcatctgatgacggcagcccgtactcgaacagaaactggcaatacctcgacggccgctggtcaaaagccgataaaacagacggaaactttatgatcagggctttggtcgactacgaagcttctgtgcctgagataacgtcgcctgaaaaccggtcatttacaaacaagaagtcaatcacggtgaaaggaacggcttcaccaaaaaccgctgtccgtcttaccaataacggtaaaaccgccgcagaaacgaaagcagatgcagacggcagtttccaggccggtgtcacactcactaaagatggcaatcggctgacagcggcatctgtgacagacagcgggtcaaccgacgagtcacgccctgtcacggtcatactggatgaggataagcctgatgtgacgattgacagtccggcaaacggtgataaaacaaataaagaagcagtgactgtaaaaggaaaagtgcacgacgcccatttaaaatgggtaaaggtgaacggaaaaaaagctgaagtaaataacggttcttatcaagcgagaacccttctggaaaacggcagcaatgagatcaaggtcacggcctcagatgaagctggtaacaaaacaacgaaaaagacggtaatcgatgtcaattacaatgctcccgtcatttccggattggttcccggagcggataaggaattaaaagccggagaatcagtgaaaatcgctttttcaagcggaaagaaattagacgcttccttcgtgatccgtctgcctctgacaaacgcccgggcagggagccaaaacgcaacagagcttccgctgagagaaatttctccgggacgatatgagggttactggacggcggcttcttccatcaaagcaagcggagcaaaaattgacgttatcgcaagagatgactacggaaatgaaacgagacagacggctaaaggaaaactttatatcaatgagtaaaaacagagcgctgccaaatcacggcagcgcttttttagttgaaggggacaatagaaaatcaaccttttcggccctcgacaaataaaacggttatcccttaaaaattgtactttaccctcaacattaattgacagactttcccacagagcttgctttatacttatgaaacaagagagagaaacagatatgtaagacaaaagaggaaaggggtcagatgtgaaaatctatctggatgtcatttggctgttgaacttttgttttgattctcttttgcttttattgaccgcctttattttaaaacgccaggtgaaaaaaagaagagtggccgccggcggtttcatcgggtcagccattgtgcttctgatgtttacgcctatttctccctttgtggagcatccggcgggaaaaatggcgttttcggtagtcatcgtgcttacggcttttggctttaaacggttccgatacttttttcaaaatttgttcgccttttatttcgcgacttttctcgtcggcgggggaatgatcggcgtacattccctgctgcagacagaatcaattgtgcagcaaggcgtaatggttacaagccagaccggattcggcgacccgatcagctggatgtttgtagttatcggatttccggccatatggtttttttcgaaaaagagaattgaagacatcgagacgaagtccattcagtacgatgaacttgtcatggtgcaggcggaattcagcggacagacaatccgcgcgaaaggattggtggattccgggaatcagctgtatgatccgctgacgaaaacgccggtcatgatccttcacattaacaaattcgctccgatcctcagcgaaaaggaaacggacttcatcaaatccgccagtccgcttgaagtgatagagcagcttgatgattcgttccgccatgcggataagctgaggctgattccatacaggggcgtcggccaggacaatcaatttttactctgtttaaagccggattacgtcacgattttaacaaaagacgagatgatcgcatgtgaaaaatgcctgatcggcatcagcacgaagccattatccgctgacggtgaatttgacggaatcgttcatccgaagatgctgacagggaaggctgtaaaacatgtttcctgacgaaaagtctgttattcatcatactcaaaacgcgtggtatttagaagggggaggaagatgaaaaaacttaagctgcgtctgacatatttgtggtataaatggctgatgaaactcggactgaaaagcgatgaagtgtattacataggaggaagcgaggcgctgccgccgcctttgtctaaagaagaggagcaggtgctcttattaaagctgccgagcggggatcaggcggcgcgggccatcctgattgagagaaacttacgtcttgtcgtttacattgcccgcaaattcgaaaacaccggcatcaatatcgaggacttaatcagcatcggcaccatcggtttgatcaaagcggtaaacacgtttaatccggaaaagaaaatcaaactcgccacctacgcatcgcgatgtattgaaaacgaaattttaatgtacttgcgccgaaacaataaaatccgttcagaggtgtcctttgatgaaccgctgaacattgattgggacggaaacgaactgctgctttcggatgtgctcggcacagatgatgatattattacgaaagacattgaagccaatgtggataaaaaacttttgaaaaaagcgcttgagcaattaaacgaaagagaaaagcagattatggaactgcgtttcgggcttgtcggagaagaagaaaaaacccaaaaagatgtagccgacatgatggggatttcacaatcttatatctcccggctcgaaaagcggattatcaaaagactgagaaaagagtttaacaaaatggtgtaaaattttttccatctgacagcccttactgctgcaaggattgccgccgccggatgtttatttctgtaaaatagcggtgcatatttttcccacccgaggagatacttaacgttgtacagcagctcctagtgggagggaaaaacgtgtcaagaaataaagtcgaaatttgcggggtggatacctccaaattaccggtgctcaagaatgaagagatgagaaagctgtttaggcaattgcaggatgagggcgatgattcagcgagggaaaagcttgtaaacggcaatctgcgccttgtcttaagcgtcattcagaggtttaacaacagaggagagtatgttgatgacttatttcaggtcggctgcatcggactaatgaaatccattgataattttgacctaagccataatgttaagttttcaacatacgctgtaccgatgatcatcggagaaatccgcagatatttgcgggataacaatccgatccgcgtctcgaggtcgcttcgcgatatcgcatataaagcgcttcaagtaagagagcggttaatcagtgagacaagcagggagccgacagcagaggaaatcgccaaagttcttgaagtgccccatgaagaaattgtgtttgcccttgacgccatccaggatccggtttcactgtttgagccgatttataatgacggcggcgatccgatctacgtgatggaccagatcagcgatgagcgcaacaaggatacacaatggattgaggagctggctctgaaagaaggcatgagaagactgaacgaacgggaaaaaatgattttgcgaaagcgctttttccaagggaaaacccaaatggaggtcgctgaagaaatcgggatatcccaagctcaggtctcaaggcttgaaaaggcagccattaaacaaatgaataagaatatccatcaataacggaaaaagcctttaaaccttgtttaaaggcttttttcatgcgatggtttacgtttgcaaaaaagtgatgtattctaatgtgtaaaagtttttagaaaatttaaataaagtaaacgggggaaacggcaatgattttacagctggacagtgtgtcattaaaaagaaacgggaaatggattttgaaagatattaactggcgcgtcgagaaaaacgaaaattgggtgctgtacggattaaacggagccggaaaaacggctttgctgaatatgttatgctcttattacttccccacttcaggagagatgcaggtgctcggccatcagttcggcaaaacagagctcggtgacaggctcagaaggaaaatcggccttgtttcggcaggtcttcagcacaaattatatgccgcggactccgcttttgaaatcgccctcagcggcgcgtacgcctcaatcgggctgtacgaaactccgagtgagcaggtaagggaaaaagcgatcggtcttctgaaggatttgggcgccatcagttacgccgacaggcggtatgaaacattatcacaaggggaaagacaaagagcgctgattgcgcgggcgcttatggctgatcccaaactgctgattttggacgagcccgtgacgggtcttgattttatggcaagggagcagctgctggacacgattacgtcgatcgccgaaaaagaaaatgcgccgtccatcctttatgtcacccatcacgctgaagaaattctgccggtatttgataaggcgctgcttttaaaacaaggcgaggtgttcgcctccgggaaaatcagggatatgctttctgacgagcggcttacagcgtttttcgatacgcctgtcaatgtcttatggaacaatggccgcccgtttttaacacgtgcaaaagaggcatcaaccgtaaaataacatcaattcaccctgggggtgctgccatgcggctgagagagacgttgtctcaacccttaacggacctgatccggatcatgccggcggagggaagcggtgaaaaaagcggaggaagatccgttttttacccgtttcattttaatgaaacgggttttttgatacagctaaaggggagatttccaatgcatcagattgatatgctgttacaacaggcggagaaacggaggcacgacttcatacatattgctgaaaggttgatcgcctttcccactccggccccgccagcaagaaatacggcagaagcccaaaagtgggtggccggctttttaaaagaaacgggctgctcggtcgatatgtgggatgtgtatccggaagatccgaatgtagtcggtgttttaaaagggacagattcaagcaggcatcaaagcctgattttaaacggacacattgatgtggcagaagccgggggcgaagattggaactctgacccgtttcagccgctcgtaaaagacggcatgctgatcggaaggggcgccgctgatatgaaaggggggttggcgtgtgttcttttctctctgaagctgatccatgatgccgcaattaagcttccgggcgacctcattgtacagtctgtaatcggagaagaagtcggcgaggcggggacgctggaatgctgcaaacgcggctatcacgcggattttgcggttgtcgcggatacgagcagcctgcatattcaagggcagggcggtgtcatcaccggctggatagaattgaaaagcaaacaaacatttcatgacggcatgaggcgcaatatgattcatgcgggcggaggcacattcggagcgagcgccatcgaaaaaatggcgaaaatcatcactgccttgggagagctggagcgccactgggcggtaacgaaaagctatcccggcattgcgcccggcaccaatacgatcaaccccgccgtcattgaaggcggaagacacgcagcgtttgtcgccgatgaatgccggttatggatcaccgtccacttttatccgaacgaaacgcacgaacaagcagccgcagaaatcgaagactatattaatcgtgtcgctgacagtgatctgtggctcaaagaaaacaggccggtgttcaaatggggcggatcttcgatgattgaagacagaggagaggtgttcccggcgctggaaatcgatccggatcatccggcagtttctgtcttggctgcatcacactctgccgtcataaaacaggagcccgtcattgatgtttcccaaaccgtaacagacggaggatggctttatcaggccgggattccgagcgtcatatacggccccggcgatttaaaaaacgcccactccgtaaacgaggaagtgtccgttgatgagcttatggactatacgaaaatcatgctgagatttattctcggctggtgcagccgcaaaaaagattgcccgatgtgacaaggttcagcccggccgttcatataataggaaaaagaacgggcaaagggcgtgatacggatgatcagcatatctgaatttcaaataaaagatgtggtaaacgtgtcgaacggaaaaaaactcggaagcatcggggatattgatattaacgtgacaacgggaaaaattcaggcgattattttaggcggcagcggaaaagttctcggttttttcggaaaagaagaggaaatgatcattccttggcgaaatatagttaaaattggggaagatgtcatcttagtgcgtgtaaatgaaccaaaggggggagcgtaatcctccctttacttgtaaaaagccggaaatctcaatgtttccggcacatttatttatctcatttttcaatcagccgctaaacgtatgcttaaaattgtgttaaaatgagtgggaaattacgcttttttaatgtttgtcgaaaggttggatctccatgaatacatatcacccgtttagtcttaccaccccctcggcactcatgatagaagactggaactgtgtgaatcagcttaacacaaaggtcatcgccggattcacaacgaaaaacggcggtgtcagcaatcctccgtatgagtcattaaataccgggttgcacgtccgggacgaagctcatgatgttgtgacaaaccgtgaagtcatagcgtccttatgcggtactgatctggattcctgggtgttcgccgaccagacacatgaaaaccgcgtccggcgcgtgacagccggggataaaggaaaaggagcgagagactattcttccgcattccgcgggacggacgggctctacacgaaagatgcgaatctttttttggccctttgttttgcggactgtgtgcccttgtatttttatgacccggtgaaatccattatcggcgctgcccatgccggatggaaggggacggtcaaacaaatcggacgcatcatgacggaacgctgggtaaacgaagaaggctcccgtttaacagatattcaggctgtcatcggttcgtccatcagcgcgggaagctatacagtcgacgaccgcgtcatcaatgaagtgcgggcgctgccctttacggctgaatccgccatatgcgaaacggaaaaaggccagtatcagcttgatttaaaagaggtcaaccgtcttcttctgatacattgcggcattccggaagaaaacatttcagtcagcggattatgcaccgaacgagagcatgaactattcttttcacaccgccgcgacaaagggaaaacgggacgcatgatgtcctttatcggaatgaaggaggcattagatcttgcgtgttgctgatcaattacgacatataaacgaaagaataaacgaagcatgtaacagatcgggccgaagccccgaagatgttaccgtcatcgcggttacaaaatacgtatcagctgaaagggctcaagaggccgttgatgccggtattacaagtctgggagaaaaccgggatgccgagcttatccataagcaggaagtcatcaaaggaagcccgaagtggcactttatcggcagtcttcagtccagaaaggtgaaggccgtcgttgaccgtgtatcttatattcattccttagacagactgtcattggcaaaagagattgaaaaacgggcgcagcatacggttcgctgttttgtgcaggtgaatacttcgcttgagccgtctaagcacggtttgaaaacagaggaggtcatcccctttatcagagagctttctgagtttagaaacatttctgtagagggcctgatgacgatggctcccctgacagacgatacagaaacgatcagagcctgcttccggcaattgcgtgatctgagggatcaggtgcaaaaactgaatcagacaaacgcgccgtgccgggaactgtcaatgggcatgtcaaatgattatgaaatcgctgttgaagagggcgcaacttttatcagaatcggctcttcattagtcggaaatgaaccggggggtgtaaacaaatgagcatgaaaaataaactgaaaaactttttctcaatggatgaggaggagtacgagtacgaatacattgaaacggagcaggatcatcaggaagagcatgaacagcagaaagataaacagcctgcttacgctcagaagccgcagggcaagcagaacgtagtaagcttgcaaagtgttcagaaatcctctaaagtggtcttgagtgaaccgcgtgtatatgcggaagcgcaggaaatcgccgatcatttaaagaacaggcgggcggttgtcgtcaatctgcagcgcatccagcatgatcaggcgaaaagaatcgtcgactttttaagcggtaccgtctacgccatcggcggcgacattcagagaatcggttcagatatttttctgtgcacgcctgataatgtcgacgtttccggcacgatttcggagcttataaatgaagacgaacatcagaggtggtaaagcaggatgattctttatcaaattttttccgttctgagttatttaatttacatctactcgtttgccctgatcatctatatctttatgtcatgggtgccgagtacgagagaaacggcggtcggacggtttctcgcagcgatttgcgaaccgtatttagagccgttcagaaggatcattccgcccattgccatgctggatatatccccgattgtagcgattatcgtgcttcggtttgccacgacgggactttggggcctataccgcatgatcgcaatgtatacttgaatgcgacagtttgatacgggcttggcaccagccaagcctctttacatagaaaggaaagaacatgagcgatatttaccagcacttcagacaagacgagcggccttttattgatcaggtgcttgaatggaaacagattgtcctggaccagtatcggatgaagctgactgatttcttagatcccagggaacaggtgattgtaaaagccgttatcggcgacgcctgcggtcttgcgtttttcggaggatatgacagagctgagcgcaaacgcgcgattttataccctgaatatatggaacctgaacaggatgattttgagctccgggcttttgacgttcaatacgctgaaaaattcgtcagcattgaccaccgctctcttctcggatcattaatggggatcggcttaaagcggcagaaatacggcgatctgattttctcagaggaagccgtgcagctcatcgtctccggtgaaatcgccgattttgtcagcactcagctgaccaaggcgggcaaagcgccggtaaagcttgagaaaatcgagctttccgctcttcacattcccgcttcagatgtcgaaataagggatgacacggtttcttcattgcgtctcgacgccgtctgcgcttcaatgagcaggcaatcccggcagaaagcgcaggcgcttgtgaaaaacgggctcgttaaggtgaattggaaagctattgaagatccgtcttatcaggttgctgaaggggacatgctctcgattcgcggcttcggacgatgcagtttggcaaaagttgacggaaaaacgaaaaaagacaaatggaaagttacatttgaacggcaaaaatgagtcgttttttcagtttttttctccatctgtgccgtatttgttttataatgtgaactagataaccgtactgaaatgtaaaaatggaggtggcaatatgccattaacgccgaatgatatccataacaaaacgtttacaaaaggttttcgcggatatgatgaagatgaagtaaatgaatttttaatgcaggtcagaaaagattacgaaatcgcactccgtaaaaaaacggagcttgaggcgaaagtgaacgagctggacgaaaaaatcggccactttgccaatatcgaagaaacgctgaataaatcaattctcgtagcccaggaagccgcagaagacgtaaagcgcaactcgcagaaagaagcgaagctgatcgtccgtgaagcagaaaaaaatgccgatcgcatcatcaatgagtcgctttccaaatcaagaaaaatcgcaatggaaatcgaagagctgaaaaaacagtctaaagtcttcagaacacgtttccaaatgctgattgaagcgcagctcgacctgctgaagaacgatgattgggatcatctgctggaatacgaagtcgacgcggtatttgaggaaaaagaataattttctgattttcttgacattcttcggcccgttcgaatataatacgttcataaattcagatgaaaagacgattgaaagggaccggcatgactcaaaacaggctataaagcgaaccggggaaggtgaaagcccgggatggccggaatcatgcagatcagccctttagtttcctttctgaaccgagagtaggaaaggacgttccatcacgttacgatgttcgagaggaaaagacggatgatccgttttttctaaaagggtggtaccgcgagataagctttctcgtcccttatgggatgagagggctttttttattttctgaaaaatgttgtggaggaatgaaaatggattacaaagatacgctgttaatgccgaaaacagattttccgatgcggggaaatctgccgaatcgtgagccggacatgcaaaaagactgggaggagcaggacatttaccgtcttgttcaagaacggacgaaagaccgcccgaaattcgtgctgcatgacggacctccttatgcaaacggagacatccacatgggccatgccctgaacaaaatcctgaaagacttcatcgtccgctataaatcaatgagcggctacaacgcaccgtacgtgccgggctgggatacgcacggactgccgattgaaacggcgctgacgaaaaacaaaaaagtaaaccggaaagaaatgtccgtcgctgatttccgcaagctttgcgaagattatgcatggcagcagatcgaaagacagcgcgaacaattcaagcgtctcggcgtcagaggcgattgggaaaacccgtatgttacgcttcagcctgaatttgaagcgcagcagatccgcgttttcggcgagatggcgaaaagaggctatatttataaaggtctgaagccggtcaactggtcgccttcaagtgaatctgccttagcagaagcggaaattgaatatcaggacaaacgttccgcgtctatttatgttgcgtttaaagtgaaagacggtaaaggcgttctggaaaacggagaaagcttcatcatctggacgacgacgccgtggacgatgcctgccaacctcggaatttccgttcatcctgatcttgaatacaatgtcatcaaggttggagacaagcgttatgtagtggcggctgaactgatcgaaaacgtagcggaggcatgcggctttgaaaatcctgaagttgtcgcatcatataaaggcagagaattagaatacatcactgcagaacatccgctgtacggcagagattcactcgtcatgctcggtgaccacgtcacaaccgatgccggaacaggctgtgttcatactgccccgggccacggggaagatgactttatcgtcggccaaaagtacggcttagaagtactgtgccctgttgatgaaaaaggaaacatgaccgacgaagcgccgggctttgaaggaatgttttacgataaagccaataaaccgatcacggagaagcttgaagaaaacggcgcgcttttgaaactcgagtttattacacactcctatccgcatgactggagaacgaaaaaaccgacgatcttcagagcgactgcgcaatggtttgcgtcaattaaagatttcagatccgatctgcttgatgccatcaaacaaacgaagtgggtgccggagtggggcgaacagcgcctttacaacatggtgcgcgaccgcggtgactggtgtatctcaagacagcgcgtctggggtgttccgatcccggtattttatgcagaaaacggtgagccgatcatcactgacgaaacgattgaacacgtgtctgagctgttcaaacagcacggctcaaacgtatggtttgaaagagaggcaaaagacctcctgccggaaggatttacacatccgggaagcccgaacggaatcttcacgaaagagcaagacattatggatgtatggtttgattcaggttcttcccatcaggccgttcttgaagaacgagatgatcttgtccgtccggctgatttataccttgaaggctctgaccaataccgcggctggtttaactcatctctttccaccgctgttgcagtcaccggcaaagcgccgtataaaggcgtattaagccacggatttacacttgatgcaaacggccgtaaaatgagtaaatcactcggcaatacgattgacccgacaaaaatcgcaaaacagcttggagctgaaattctgcgtttatgggtatcttccgtaaactatcaggccgatcacccggtttctgaagatattctgaagcaggtcgcggaagtataccggaaagtccgcaacacgttccgcttccttcacggcaacctgttcgattttgatccaagcatcaatgccgtggatgtaaaagatctccgcgaagtggatcaatatatgctgatcaagctgaataagctgatcgataaggtgaaaaaagcgtacgatgaatacgaatttgcggttgtttatcacagcattcacaatttctgtacgatcgagctcagctccttctatcttgattttgcaaaagatgttgtgtacatcgagcatgcggatcatccggaccgccgcagcatgcagaccgtcttttatgaaacgctgctggcgttagtgaaactgacggcgccgattctcccgcatacggcggatgaaatgtggtctcacttatcatttgttgaagaagcgagcgtgcagctgacagatatgccggaaaccattgctgttccggacagtcaggcgacagaagaaaaattcgaccgcttcatggagcttcgaaacgacgtgctgaaagctttggaaacagcccgtaacgaaaaaattatcggaagatcattggaagcgagccttactttgtatccgaacaaagaaaaccgcgacctcttgtcatccattaaagaaaacatcgcgcagctgtttatcgtctcagaactgacagtaaaagacgaaagtgaagcgccggaaaacgcgcaaagctttacaacaggaaaaatgaccgtagaaaaagcggaaggccagatgtgtgagcgttcccgcgtaatttctaaagatgtcggagccaatccgaaatatccgacattatcactgcgcaatgcggaaatcgttgaaaaatattatcaaaaataataaatgagaaagcgcccggtgtcagccgggcgcttttttacatgccagcaatgtcatcgattagaacggcaggaaaattcttatgggcttcaaatagcgctctgagggcaacaataaagctataacatcaagagcaggagttgtgatgaatgaatgatcaactgaccgcaatccacacggagcttctcatgatgaaagaagaacttcaatcaagattattcgaatattcttgctttcaaatgtcagcatctgttgaaccttcaatgaacgaccaagaagcaactctgatctatcatataaaagaagaacttcaggatgttcttcttgccctgtctaagtttgaaaacaatacgtacggttattgtgaaaaaacaggcgcccccattccgattgaaaaacttgcggtgctgccgacggccagaaccgctgatgatttttattatcccgctcaatttgaaaagaaaacccttccatactgggtaaccggagattatgcatatgatcaggcgctgtatgagtgacagcgtctgtttgcatacgcttatgatctgcctttactccggcatcttttactgataaaattcataaaggataaaagtaactgtatactggaggaacgtgtgtgctttattatcttatcgctctttttattattattgccgaccaattgaccaaatggcttgtcgtcagccatatggaattgggacaaagcatacctgtcatcgaccaggtgctttatatcacatctcatcgcaacacgggagcagcgtgggggattttagccggccaaatgtggtttttctacgtcattaccatcgccgtgattatcggaatcgtttattacatacagcgttatgcaaaagggcagatgttactcggaatttctctcggcttaatgctgggaggtgcggccggaaactttattgaccgggcggcgcgccaggaagtggtggattttattcatgtcatcatcgtggattatcactatccgatttttaatatcgcggactcctcactgtgcgtcggtgtaatacttttatttattcatatgctgtttgacagcgggaaaaagaaggagcaataacatgaatcaatttgagataaccgttcagcctgaacaaaagagcgaacggattgataaatttttggcttcaacgggagaaaactggtcacgcactcaagtgcagcaatgggtaaaagagggactggtatccgttaacggcaaatccgtaaaagcgaattataaaatgcagcccggcgatcaggtaaacgtcaccattcctgaaccggaagaattggacgtgcttgcagagccgatggatttggacatttactatgaagaccaggatgtcttggttgtgaacaaaccgcggggcatggtcgtacacccggcgcccggccatgtgacagggacgctcgtaaacggactgatggctcactgcaacgatctttcaggcattaacggcgtcatgcgcccgggaatcgtccaccggattgataaagatacctccggcctgttaatggtcgccaaaaacgatatggcgcatgaatcactcgttaatcagctcgtcaataaaaccgtgacgagaaagtacacagcggttgtccacgggttgatttcacatgatgacggaacgattgacgctccgatcgggagagataaaaaagaccgacaaagcatgaccgtaacaagagaaagcagcaaaaacgccgtcacgcatttccacgtgcttgagcgttttcaagacttcacgctcgtagagtgccgtcttgaaaccggaagaacgcatcagatccgtgttcatatgaaatatatcggatttcctttggcaggcgacccgaagtacggaccgagaaaaaccattgatttcaacggtcaggcgcttcatgccggaatattaggttttgaccatccgcggacgggcgaatacatggagtttgaagcgccccttcctgaagatatgaaaaaactcattgaacatttgagaaatagccattgacagcgagtttcttttctgaaataataaaaacaagctgaatagattctttaacacagtccagagaggctgagaaggataacggataggacagaagagatacacgtgtgtcttggtcctggaaaggaacccctctatgctctggcaggaggggttttttcttcttatatacgaatggagaggtgtcacgattgaatcaaaaagctgttattctcgacgaacaggccatcagaagggcgctgacaaggatagcccatgaaatgatcgaacggaataaaggaatgaatgactgcattcttgtagggattaaaacaagaggtatttatttagcgaagcggctggccgagcggatcgaacagattgaaggaaatccggtcaccgtcggggaaatcgatatcaccctttaccgtgacgatctcacaaaaaaaacgagcaatgaagagccgcttgtaaaaggcgcggacattccggccgatatcacagaccaaaaggtcattgtggttgatgatgtgctttataccggccggacggtgagagctgcgatggatgctctcgttgatgtcgggcggccgtcatcgatacagcttgccgtgcttgtcgacagaggacaccgggagctgccgatcagagcggactatatcgggaaaaacattccgacctcaaaagctgaaaaagtgatggttcagctgagcgaagttgatcagactgatatggtcgccatttacgaaaatgaataaccaccctttttaaatgcattccagagagtttgcaaagaggattttaaaacacaaagccgggcggatcgacacggccgggctttgtatgcctctttgcgcaaaaagcaaagaggtttttttataccatttgaaagtcaaccgggaggaaaacgccatgagtaagaaaaaagtaaacctgggagtcagggacgtccccaatccattgtcctggctgtcattcagcctgcagcatttattcgccatgttcggttcaaccatactcgtgccgaaactggtcggaatgagcccggcagtggcgcttgtcacgagcggaatcgggacactcgcctatctcttggtgacaaaaggccagattcccgcttatctcggctcatcattcgcctttatatcaccgattatcttggtgaaggcgacgggagggccgggggctgccatggtcggcgctttcctggcgggaattgtgtacggcctgatcgcgcttctcatcaggcagcttggaacggggtggctgatgaagctgctgcccccggtggtcgtcgggccggtcatcatcgtcatcggcctcggactggcaagcacagccgtcaatatggcaatgtatgctgatccgaatgcgaaggaactcgtttacagcctgaaacatttcagtgtagccggcgtcactttggccatcaccattatctgcgccatctttttacgaggatttttaagcttgattccggtattgatcggcattataggcggatatctgtttgcgctgacacagggcatcgtcaattttcagccggtcattgatgcaaaatggttcgccgttcctgaatttatcatccctttcaaagactacacgccgtcagtgacattgggcattgccgctgcgatggtgccggtcgctttcgtgacgatgtcagaacatatcggccaccaaatggtgctgagtaaagtcgtcggacaggattttattaaaaagccgggactgcaccgctccataatgggggacagcgtagcgacgattatcgcttcgttaatcggcggcccgccgacgacaacatacggcgaaaacatcggtgtcctggcaattacgagagttttcagcgtctttgtcatcggcggcgcaggagtgattgcgctgtgcttcggatttatcggcaaagtttcagcgctgatcagctctgttccgtccgcggttatgggaggcgtttccttcctgctcttcggaatcattgcctccagcggcttgagaatgctgattgacaacaacattgattatgaaaacaagcgaaatttaattatcacatccgtcatcctcgtgatcggcgtcggaggggcttttattcaagtatcaaaaggcgggttccaaatatccggcatggcgcttgcggcaatcgtcggagtcatcctgaaccttatcctgccgcatgcaaatgaagaagacgcgattgcatcggaaaaactaaatcatatgtaaaccttttaaagaaagtccagagaggcttggaagggttataacgggaagacgctgtacggctcttctctctttaaccgcaccccgagtctatagaccggggtgttttttacggccttcaagcggaaacggaggagaaaaaacatgaatcatttaacggcgatgtctgaactgagcgcggctgaaattacagaactgctgcgagaggcaaaagcgataaaagagggtgcagtccgtcccgatctcgcgggaaaattcgttgcgaatctgttttttgaaccgagcacgagaacgcggttcagctttgaagtggcggaaaagaaactcgggatgaacgtgctcagcttagacggcacgagcacaagcgttcaaaaaggcgagtccttatacgacacggtcaaaacactggaatcaatcggagcggacgcctgcgtcatcaggcacagcacggatgaatattacaaagatctgaccggcagagtcaatattccggtcttaaacgcaggagacggctgcggacagcacccgacccagtcattgcttgatttaatgacgattcaagaggaatttgagacctttcagggcctgacggtttccattcatggcgatatcaaacacagcagagtggcaaggtcaaatgccgaggtgctgacaaggctcggcgcacgtgtgctgttttccgggccgccgcagtggcaggatgagaaaaacgccttcggcacctgtgttcagacggatgaggccatacaagcttcagatgtcgtcatgctgctccgcatccaaaatgaaaggcatcagacagaagccgaccaaaaaggctacctggaagcatacgggctgaccgaaaagcgggcgcagagcatgaagcggcatgctatcatcatgcatcccgcaccggtgaacagaggagtcgaaattgacacaacattagtggaatgcggaaaatcaagaatctttaaacaaatggaaaatggtgtgtatatcagaatggcagtcttaaaaagagcactgcaaaccaatgtgaaaaggggagaagcggcttatgtcttatctcattaaaaacggctggatattaaatgaacagggagaaaaagcggtacatgatatccgggtaacgggtgaattcatttcggaaaccgggcttctgacagcgaaagacggagaaacggtgatcgacgctgagggactgttcgtttcacctgggctcgtagaccttcatgtccacttcagagaaccgggcggcgagaaaaaagaaaccattgagacgggctctaaagccgcggcgcggggcggttttaccacagtcgccgccatgccgaatacaaggccggtgccggatacgaaagagcagatggaatggctgcaaaacaggatcaaagaaacctcatctgtcagggtccttccttacgcatcgattacgatcagacaaaccggcgaagagatgacagattttgaggcgcttcatgaagcgggcgcattcgccttcaccgatgacggcgtcggagttcagacggccggaatgatgtatgaagccatgaaacgggcggcttcaataaataaagcgattgtcgctcattgtgaggataactcacttatttacggagggagcgtgcatgaaggttctttttcaaaagcgaacggcctgaagggtataccttccatttgtgaagcggtacatatcgcccgtgacgtgctgctggcggaagcggcgggctgccattaccacgtgtgtcatatcagcacgaaagaatccgtcagagccgtaagagacgcaaaaaaagcgggcatccgcgtgacggcggaagtatcgccgcaccacctgctgctttgtgacgaagatatcccgggacttgataccaattttaagatgaatccgccgcttcgcagcaaagaggacagagaggcgctgattgaagggcttttagacggcacgattgatttcatcgccactgaccatgcgccgcatacagaagaagagaaaaacacggacatgaagcttgcgcctttcggtattgtcgggttagaaactgcctttccccttctgtacacacattttgtgaaaaacgggacgtggacgctgaagcagctggttgatttcatgacggtaaaaccttgcgaggcattcggtcttccgtacggaacgcttgcaccgggggcgccggctgacatcaccctaattgatctggacaaagaagcggccattgacaaagatacatttttatctaaaggaaaaaatacgccattcaacaagatgaagtgcttcggctggcctgttgcaacgatggctgccggtaagcttgcatatgaagaagggagactcgtcaaatgaaaagaagactagtgctggaaaatggagcggtatttgagggtgaagcattcgggagcctggagcataccgcgggtgaagtcgtattcaacacgggaatgaccggttatcaggaaattttatcagacccttcttactgcgggcagatcgtgacgctgacgtatccgctgatcggcaactacggaattaacagagatgactttgaatctatcactccttttgtaaaagggctgatcgtaaaagaactgtgcgagctgccttccaactggcgctcagcttacacgcttgatgagtatctgaaaatgaaaaaaatccccggcttacaagggatcgacacgcgaaaactcaccagaatgatccgcacggccggggcattaaaaggaacgtttgcttcaagtgaggagaatgtcggagaggttcttgcaaggctgaaagaaacggaactgccgagaaatcaagtcgctcaagtatcggcgaaaacggcatatccgagtccgggccgcggcaaacgcatcgtgctcgtcgatttcggtatgaagcacggcatcttaagagagttaaacaaaagaaaatgcgatgtcatcgttgtaccgtacaatgtaacggcggaagaagtgcttcagctcaagccggacggcatcatgctttctaacggacccggagatccgaaagatgtgccggaagccattgaaatgataaaaggcatactcgggaaggtgccgttattcggaatctgtctcggccatcaattatttgcgctggcatcgggagcggaaacggaaaaaatgaaattcggacacaggggttccaatcatccggttaaagagcttgcgacagggaaagtcgctttaacagcccaaaaccatggatatacagtttcttcaatagatgagacagagcttgaagtgacgcacattgcgatcaatgatcaaacgatcgaaggactcaagcataaaacattgccggcatttacggttcagtaccaccctgaagcttcaccgggaccggaagacgccaatcacttatttgacagattcattgacttgatcgaaacaactgagaaagaaggggaagcggtatgccaaaacgcgtagatattaaaaagattttagtgatcggatcaggcccgattattatcggacaggcggcggaatttgattatgcgggcacacaggcgtgtctcgctttaaaggaagaaggctatgaagtcattctcgtcaactcgaatccggcaacgattatgacggatacggaaatggctgatcgggtatacatagaaccgctgacgccggagtttctcacgcgtattatcagaaaagaacggccggacgccatcctgccgactctgggaggacagaccggactgaatcttgccgtcgagctgtctgaactcggggttcttgaggaatgcggagtggaagtgctcggcacaaagctgtccgccatccagcaggctgaagaccgcgacttattccgtacgctgatgaatgagctgaatgaaccggtgccggaaagtgagatcatccgcactttacaggaagccgaggaatttgtcggccggatcgggtttccggttatcgtgcgccccgcttacacattaggcggaacgggcggcggcatctgctcgaatgaagcggaactgaaagagatcgtcgaaaacggattaaagctcagccccgttcatcagtgccttctggaaaaaagcatcgccggttacaaagagatcgaatatgaagtcatgagagacagcagagatcacgcgatcgtcgtctgcaacatggaaaatatcgatccggtcggcatccatacgggcgacagcatcgtcgttgccccgagccagactttgagcgaccgggaatatcagcttttgcgcaatgtttcattaaagctgatccgcgcgctcggcattgaaggcggctgtaatgttcagctcgcgctcgatcccgacagcttccaatattacattatcgaagtgaatccgcgagtgagccgctcatctgccctcgcttcaaaagcgacgggttacccgatcgcaaagcttgcggcgaaaatcgcagtcgggctttctcttgatgaaatgatgaatcccgtaacgggaaaaacatatgcggcttttgagcccgcgcttgactatgtcgtttctaaaatcccgcgctggccgttcgacaaatttgagtcggcaaaccgcaggctcgggacgcagatgaaagccaccggagaggtcatggccatcggacgcacccttgaagaatcgctgttaaaggcggtccgctcactggaagccgatgtctatcacctggaactgaaggatgcggaagagatttctgacgggcttttggaaaaacggatcagaaaggccggagatgaacggctgttttatcttgcagaagcgttcagaagaggctacacagtggagcagcttcatgagttttccgcaattgacgtattctttttgcacaagctctgtaagctggtcgcttttgaaaccgagctgaaagcggaaaaaggcagcctcgccgtcctgcagacagcgaaggaactcggtttctccgacaaatatatcagccgggaatggaatatgccggaacaagagctgtatcaaatgcgaaaagaagcagccatcaagcctgtatataaaatggtggatacatgcgcggcggaattcgaatcagaaaccccgtacttctacagcacatatgaggaagaaaacgagtctgaggtaacatcaagaaaaagcgtcgtcgtcctcggctccggcccgatccgcatcggacagggcgtcgaatttgactatgcgaccgttcactctgtctgggcgattaagcaggcaggatatgaagcgattattatcaacaacaaccctgagacggtgtccactgatttcagcatatcagacaaactgtattttgaaccgctgacggtagaagatgtcatgcacatcattgatttggaacagccggaaggcgttgttgtccaattcggcggccagacggcgatcaaccttgcggaagaattgagcgcccgcggcgtcaaaattctcggtacatcacttgaagatttagaccgtgcggaagaccgggataagttcgagcaggcgcttgaggcgctgaatgtgccgcagccgctcggaaaaaccgccgtgtcggtgaacgaagcggtcaaaatcgctgcatccatcggctatccggtacttgtccgcccttcgtatgtgctcggcggccgggcgatggaaatcgtctatcacgaagaagaactgcttcactatatgaaaaatgcggtcaaaatcaacccgcagcatccggtgttaatcgaccgttatctgacggggaaagaaatcgaagtcgatgccgtatctgacggcgaaacagtcgttattccggggattatggagcatatcgagcgggccggcgtccattcaggggattcaatcgccgtctatccgcctcagtctttaagcggagacattaagaaaaaaatcgaacaatacactgttgccttggcaaaaggccttaacatcatcgggttgctgaacatccagttcgtactttcgcaaggtgaggtgtatgtgcttgaggtaaatccgcggtcaagcagaaccgtgccgttcttaagcaaaatcactaagattccgatggcgaatctggcgacaaaggtcattctcggccaaaagcttgctgatttcggctatcaagaggggctgcagcctgaacagcagggggtgttcgtgaaagcgcctgtcttctcattcgcgaagctgagaagagtggatatcacgttaggccctgaaatgaagtcgacgggagaggtcatgggcaaagattcaaccttggaaaaagcgctctataaagcgctgattgcctcaggcattcaaatcccgaactacggttcagtgctgttgaccgttgctgataaagataaagaagaaggactgctgatcgccaagcggttccacgccatcggctataaaatcttggcgacggaaggaacggcggcttatttgaaagacgctcagattccggctcaagtcgtcgggaaaatcggcgaagaagggaaaaatctgctcgatgtgatcagaaacggagaagcgcaatttgtcatcaatacgctgacaaagggcaaacagccggccagagacggcttcagaatccgccgcgaatccgttgagaacggagtcgcctgcctgacatctttagatacggccgaagccattttgcgggtattggaaagcatgacattccgggcggatcatatgcctgcatccgaaaccaatcaaaaggcggcagtcacgatatgaaaaaagcgcatttgactgttcaatccaacttagaaattgccgaccggatttataagatggtgctgaaaggagagcttgtccggcaccttaccgagccgggacaatttcttcatctgaaggtgagtgacgcggtcacaccgctattaagaagaccgctcagcattgcggacgtcaatttcgccgcggatgaagtatccgttatctacagagctgacggtgagggaacgcgccttttgtccgggaaaaaagagggcggcaaaatagacgttctcggccctctcggcaacggatttcccgtgcggcggattgaacccggcaaaaccgcgctgttagtcggaggcggagtgggggttccgcctttgcaggaactgtcaaagcgcctgacggaaaaaggcgtaaacgtcattcatgtgcttggatttcaatcagcaaaggatgttttttacgaacaggaatgccgtgcgtacggagacacttatgtggcgacggctgacggaacatatggagagaaaggatttgtcaccgatatcatccgtgaaaagcagctcgaattcgatgtcctgctaagctgcggaccgacaccgatgctgaaagctctgaagcagcagtacggccataaagaggtttatctttcgatggaagagcggatgggctgcggcatcggggcctgcttcgcctgcgtgtgccgcacgggtgaaagcgatacatcctatgtaaaggtctgccttgacgggccggtatttaaagctgaggaggtggcgctgtaatgttagaggtgaatctgccgggtctccaattgaaaaacccgatcatccccgcttccggatgtttcggtttcgggaaagaatatgccggattttacgatttatcatgccttggaggcattatgattaaagccacgacgaacgaagcccgcttcggaaatccgacgccgagagtggcggagacaagcgcgggaatgctgaatgccatcggactgcaaaatcccggccttgagcatgtgctcaatcacgagctgccttggctcgaacaatttgacacgccgattatcgcaaatgtcgccggttctcaggtggacgactataaagaagtggccgagcacatcagccaagcgccgaatgtgcatgcgcttgagcttaacatttcatgtccgaatgtcaaaacggggggattgcttttggtactgatcccgtcatggcggccgaactgacaaaagcggtgaaagaagtttccgcagtgcctgtgtatgtgaagctttcgcctaatgtcgcaaacatagccgaaattgccaaagcgattgaagcggccggtgctgacggtctgacgatgattaatactctcatcgggatgaggctcgatctcaagacgggccggccgattttagcaaataaaacgggcggactgtcaggcccggcgatcaaaccggtcgccatccggatggtatacgaagtcagccaggccgttcaaattccgattatcgggatgggcggcgttcagaccgcagaggatgcattagaatttcttcttgcgggagcgagtgcggttgccgtcggcacggcgaacttcgtcaatccgttcgtctgcccggaaatcatagaacagctcccccacgtgctgcgccaacacggctttcaatctgtaagtgaatgcatcggaaggagctggaaacatgaaaaacaacctgcccatcatcgcgcttgattttgcatcaggggaagagactttaacgtttttagacttgtttgaaaaggaaaggctctttgtcaaaacggggatggaacttttttatcaggaaggccccgccatcattcaccaattaaaagaacggaactgtgatatatttttagatttaaagcttcatgatatcccgactacggtcaataaagcgatgaagcggctggccggcctcggcgttgatctcgtcaatgtgcatgcggcagggggcgcacgcatgatgcgcgcggcccttgaggggcttgaagaaggcacgccggcaggcagaaaacgcccgtctttaatcgcggtgactcagctgaccagcacttcagagcaggtggcgaaggaagagcttctgctgcataagccgctgttagaaacggttgtgcattacggcaaaatggcggaagagtgcgggctggacggagtggtatgttcggtccatgaaacaaaagccatttatgaagcggtccggccttcatttctgacagtcacgccgggcatccgcaccgccagtgacgcagctgacgatcaagtccgtacggcgactccgtcatttgcgaaagaaaacggttcgtcagccatcgtcgtgggccgctcaattacaaaagcggaaaaccccgttaaagcatatgaagcaattaaactggaatgggagggcgttcgccgatgaaacaggctatcgcaaaacatctattacacattgaagctgtctttttacgcccgaatgagccgtttacgtgggcgagcggcattttatcaccgatctattgtgacaaccgtctgacattgtcgtatccaaaagtgagaaatgatgtggcggacgggctcggcaaactgctgaaggagcatttccccgaggcggagatgatcgcgggcactgcaacggcgggcattccgcatgctgcgcttctcgcagaccgtacaggcgcgccgatgtgctacgtcagaagcaaaccgaaagcgcacggcaaaggaaatcaaatagaaggcgccattaagaaaggacaaaaaacagtcgtgattgaagacttgatttctaccggaggcagcgtgcttgaagctgcggcggcccttcaaagagagggcgcggaagtcctcggcgtcatttccatttttacatacggactgccgaaagcaacagaagcctttaaaaaagcgggtcttccttattactcgttaaccgattatgacacgctgattgaagtcgcgcttgaaaacggtacgattcattcagctgacattgaaaaactgaaatcatggaaactgaatcccgagtcaaaagattggtttaaaaaataatgacaataaaaacaggcctcagggcctgttttattattcctatcaaaaaactcgggttgacttctgttagaattgtgctaaaatttagtacaaatctaaaaagcttatcaagagcggctgagggactggaccgatgacgcccggcaacctgcgtgtattgcaaggtgccgcatccagaaaaatgcacagcattttgaagataagggctataccgggtcactgtctttcattccgctggattgaaagttttttatatgaaaaaaagattgagggataagacaaccggcagagaacaacaactgtttgattgtctccgggaggaggaaagaaaaaatgctaacgtatgatacatgggaggaaccggcgattacatttccggaagacgattcctataaaggcgcgctgtccgttttaaaatgggcatacggccactacggagaccagcttgtttacgcgtgcagcttcgggattgagggcatcgtcctgatcgatttaatttctaaagtaaagaaagacgcggaaatcgtgtttctcgatacgggtcttcactttaaagaaacatatgaaacgatcgaaaaagtgaaagaacgttatccggggctgaacattatcctgaaaaagcccagccttactctcgaggaacaggccgaggctcacggagataaactgtgggaaagagaaccgaaccagtgctgctacatcagaaaaattctgccgttaagagaagcgctcgcagggcatccggcatggctgtccggccttcgccgggatcaagggccgagccgggcgaatacgaatttcctgaataaagacgacaagtttcaatcgattaaagtatgcccgctgatccattggacatggaaagacatctggagatatacttccaagcatgagctggattacaatatcctccatgatcaggggtatccgagcatcggctgtgaaccgtgcacttcacctgcgtttaccgcggaagatttgcggagcggcagatggaacggcatggcgaaaacagaatgcggactgcatgaataaaggagctgcccgatggaattagccgctattttattctgtctgttttttgccatgaatatcggagccagcggagccgcggcatcaatgggagtcgcttacgggtccggcgccgttaaaaagaaaacgtatgcgctgatcatctgcgcggccggagtcctgtcaggggcggttatcggcggcggtgaagtcgttaagacgatcagcggcggaatcattcccgaacaaaccattacgctcaccattgtctgcattataatcggagcggcggcgctatcgttattcacggcgaatgtgctcggcattccgctgtcgacgagtgaggtcactgtcggggcgattgtcggtgtcggcgtcgcgtacaaagtattgtttttacagcatcttttggtcatcgtgattttttgggtgctcgtaccgttcgtcgcgttctgtttcacttttctcgtatcgaaggtattcagttctctgaatattcgagtcatttcgaaacggaaacagaagattttaggaattgtgctgctttttgcggggttttgggaagctttttcagccggaatgaacaatgtcgcaaatgcggtgggccctttggtggctgcgggcgtactcagcgtgtcaaaaggaacgctgtacggaggcatctttgtcgctctcggcgctctgcttttaggacgcaaagtgcttgaaaccaacgggaaaaagattacgaggttttcagccggagaaggcatactgctttcaggaaccggtgcggggcttgtcattatcagttccgtcttcggtctgccggtcccattggcgcaagtcacatcatcatcaattatcggtatcggaatggccaaaaacgggccgaacgtttttcataaagaagtcgtgaaaacgatgctcaaagtatgggttgtttcgccgtttttgtcactgtcgatttcgtatctgcttgtctccctgctgttaaaaggagattactattccatctttatgatggccagcgtgcttttggcagctggcggagccgccagtctgatgaaagccatccgaaaagagaaacgctctgtccatgaacaaggcgggggcatttaactattaatctgagtttatttatctgttaactgggaggaatcatgtattatgagtttagcaccgcacggaggaacattaattaatcgggtgaatgagcagtatgatcttacatccgtccacaaagaaattgagcttgatttgatttcgttcgctgatttagagctgatcgggatcggggggtacagcccgattgaaggatttttcacagaaaaagattacgtatcagtcgttgaaaatatgcgtctagcatcagggttgtctggtccctgccgatcacgcttccggtcgattcagaaaaagcggctgagcttgccgtcggcgacacggtgaaactgacttacggcggagaaacatacggcgtcgtcgacatcgaagatatttatacgccggataaacaaaaagaagccgttcacgtatataaaaccgatgatgccgcgcatccgggcgtgaaaaaattattttcacgcggcgatacgtatgtcggcgggccgatcacattaattaaaaaagcgtcaaagcagtttcctgagtttacatttgaacctgccgatacaagacgaagcttcgaagaaaaaggctggaaaaccatcgtcggtttccaaacgagaaatccggtccaccgcgcccacgaatatatccaaaaaaccgcgcttgagacggttgacggcctgtttttgaacccgctcgtcggtgaaacaaaatcagatgacattccggcggatgtcagaatggaaagctaccaggtgctgctcgatcattattatccgaaagaccgcgtattcctcggcgtgtttttggcggcaatgcggtatgcggggccgagagaagccattttccacgcgcttgtccgcaaaaactacggctgcacgcattttattgtcggccgcgatcatgccggcgtcggtgattactacggcacatatgaagcgcaagagctgtttgatcaatttacagcggatgaactcggaattacaccgatgaaattcgagcacagcttcttctgccagaaatgcggcaacatgggaacggccaaaacatgtccgcatgacagagaagaccacgtcattctgtcaggaacaaaggtcagagaaatgctgcgaagcggcgtcatgccgccggcggaattcagccgtcctgaagttgtcgaggtgttgattaaagggctgaaaacgaaagaagaagcaggcgtttcttaaggaggaaaatagagtgacaaatcgtgatatcgtatggcatgaagcctcaataacgaaagaagaataccagcagaaaaacaagcataaaagctctatcctctggctgacgggcttaagcggttcagggaaatccacaattgcaaacgccgcagcgcgcgagctgtttgaacaaggctatcaagtcattgtgcttgatggggataacatccgccacggcttaaacaaggacttaggtttttccgatgatgaccgcaaggaaaatatacgccgcatcggggaagtggcgaagcttttcgttcagcagggaaccatcgtcatcacggcttttatttctccgttccgtgaggacagagatcaggtgagagagcttgtggcagagggcgaatttaatgaaatctacgtgaaatgcgacctcgatatatgtgaaaagcgcgatccgaaagggttatataaaaaagcaagaaatggtgaaattccgttctttacggggatcgactcaccgtatgaagagccgaaagcgcctgagctcgtacttgattcaggcaaatttgaacgtgaagaatgcaccggaagactggttgactttgtgaaaaacagcttagcataataggtccaaaaaggccgcgcaatcagccggatatcccccgcaatggcgggatatggtaaaatagctgaagtgcggcctcgcggctgttctgggaagatttcaaaacggatcggggagacatgctatggggaaagtatttatcgttggagccggtccgggagatccggacttattaacggtgaaggcaatgaaagccatacagaaagcggacgttatattatatgacagattggtaaacaaagagattttacagtacgccggagaagaagcggatctgatttactgcggcaagctcccggattttcacattatgaaacaggatacgatcaaccgtttccttgtgaagtatgcgaaaaaggggaaaaccgttgtaaggctcaaggggggcgacccgtttgttttcggccgcggaggcgaagaagcggaggctctcgcgcaaaacgccattccgtttgagatcgttcccggcattacatcaggaatcgcggctgctgcttatgccggcattccggtgacgcacagagaggcgagctccaatgtcgcattcgttacggggcattataaacaagaagacgactttgaagaaaaatggaaagcgctggcgacgggcattgatacgctggtgatttatatgggaattaaaaatatccggcagattgaaagaatgctgctggaaaacggcagagacggcggcactccggcagcctttattcattgggggacgacggacaggcaaaaaacagtcgtctgcaccgtcggcacgctttcagacacagtgataaaagaagaaatcaaaaacccgagtttaattgttatcggtgatgtcgtcaattatcactgcatactggactggtatgcatctgatcagaaaaatccggatttgagcgaggcgttgtaaatgaagcaggcgattttatatatcggacacggaagcaggctgaaaaaagcgcagacagagtcggcggcgtttttaaaagggtgcatgccacacgctgacgctcccattcaggaaatctgttttttagaactgcaggaaccgtctattgaagcgggatttgaagcttgtgtcagacaaggcgccactcatattgcggctgtgcctttgctgctgttgaccgctgcccacgcgaaacatgacattccggctgaaatcgcccgtgcggcggccctgcatcccgatataaaagtgacatatggtgttccgatcggagtggacgatgaagtcgtaaaagccgtgcatcatcgcattgaagataccggagtgtccattgagcaggcgaaagtggtgctgatcggaagaggaagcacagatccggcagttaaaagcgcagtcagtgagattgccggaaaacttgaggcgattacacctgttaaagaagtcatcccttgttttttaacagcatgtgacccgcactataaagaagtgtttgccggccttgaagaggatgacggagcacccgtttttatcgttccatatcttctgtttaccgggcttttaatgactgagattgaacgggaagttcaaaagcttcaaacggtcaatcaaaatgttcatctcgcttcatacttaggttttcacccgcatattaagcaggcgtttttgaaccgtgtgacggaagctgtccgaaaccccggcgggcagtttgattttaaggggggacagtatgctgcctctgcacattaatctcagcggaaaaagaattgtcatcgcgggcggaggcaatgttgccttaagaagactcaaaacagtgctttcggaaggcgcggatattactgtaatcagtcccgatgccctgcctgaaattaaacagctggcggatgaaggacgtatccgctgggtttcccgtaaaattgacatgaaggatctcgcgcccgcttttttcatcattgccgcgacaaatgaccgcaacgtgaatcgggagataaccgagggcgcttctgaaacgcagctggtcaattgtgtaagcgaggctgaacggggcagcgtgtatatgccgaagatcatccgcaaagggcgcattcaagtatccgtatcaacaagcggcgcaagccctgcacatacgaaaagactggctgaggacataaagcctctcattactgctgatttggctgaagaagtggatcgattatttgagaaaagaagaagaccataaaaaacaccctgtctgtcatcaggcagggtgttttttatactgtcctgacagtccgccgaatgtgaaaaattcaaaacgaaagcgggcagtttgaatggtatatgccgacaagcggtcaggattgcgaagtgatgcggaatatgtatgtgatcccgatgccgcctggatttcgcccgcatacaaaggaaaggtcagagacccgcccggatgtgctcaggttcggcgagggaaggtgaaagtatccgccgccaaatcaggtgtgaccgtttaaatcacagacggcccggcggatcatgcagacatgacgggaaactgatcagatactgtaaagatcggttctgacggctgggagagtttcgtctccgtttatacgtaataaaaaacacttccaagccgagtgcgggtttcagcttggaggtgcgtttattttttcagccgtatgacaaggtcggcatcaggtgtgacaaatacggtatgctggctgtcataggtgacaaatccgggctttgcgccgtttggctttttcacatgtctgatttttgtataatcaaccggaacggagccggaatctttcgctttggaaaaataagcggcgatcgcagccgcctccagtatggattgttcatccggatcgctgcttttaatcacaacgtgggaacccggaatgtctttcgtgtggaaccataaatcatccctcgcggcagcttttgtcgttaagtactcattttgtttattgtttttgccgacaagaatcgtcaatccccgtgaagattcatattgctccaaaacaggaacgtgctgcttctgttttttctgtcctctctgctgtttcggccgcagatatttgccttccacaagctcttcccttatttcgtgaatatcctttgtggaggcggaggagagctgctggatcagctgatcgaaataagcgatttcctcctcggccagacggatctgttcttttaccacctcgacggaattcttcgccttttgatactttgtaaaatacatctgcgcgttttctgacggtgttttgttcggatttaaagggatggtcaccgtcttactttcttcatcataataattgatgacttccgcttctttgtcaccttttttcagcatatacaaatttgccgtcagcagttcgccgtatagctggaattccttcgcattttctgagtagtcgagcgtcttttccagcttttttatcttattggcattctttttccgttcatttgcgacaaaacgctcgagatcctgagcctgctgtttgacgcggtcgcgttccgctttgccgaaataaaaccggtccaacagctcactcagtgagtgaaaggtgcgctcctctccgtttacatgtgtgagagacaggagataaaagtattcctttccgccggctgtcgtaatgttcggtgtaaacctgcaatctttcacggcatggaacatttcaatcagcgtcttcggcagcgttattttgttagcgagacccgctctgtgcacggcttcttttgcaaacagcggagaaacaccggagaaatgtctgacgatctgctggtcaagccgtccttcctgaaaactgagataacgcaaaacgtcctcttcatccgcggcaagcggcgaaattttttcctgagcgggaggaagcttgtaatcatagcccggcagaacggtccggtagctgttcatcgacggagataaatgcttcagcccgtcgatgatggatccttctccgtcagtcagaataatattgctgtgccgtcccataatttcaacatacagcgttcttacggtttcgtcgccgatttcatttctgctttttatgcggaatatcataatccggtctaatccggcctgttctattttctcaataaatccgccttctatatgctttctgagcagcatacaaaacatcggcggctcgctcggattttcataggcctggtttgtcatgtgcacccgtgaatagctcggatgcgccgacaataataatttgtggtttgttccgttggcgcggatatggaatatcacatcgtgcttaaaaggctgatggactctcgtgatccgtcctccggcgatccggctgtttaattcatgtgtcattccgtatgtaaacatgccatcaaaagacatataaaacaccctttccttcttcctgcattcgataattatagcatgaaaagggacgagtcagaataagcttgtttacagagtgacatctctaaagcgaggcaggggagtggacgagaagaatgaagtttcatgaaatgggacaaaccgatttgctgaaagcaacaaatacgtccattaaacaggggttgaccgaaaaagaggtgaaaaaacgccttgaaaagcacgggccgaacgagcttcaggagggcaagaggacaccggcgatcgccgtgtttttcgcccaatttaaagattttatggtgctcgtgctgctggcggcaaccttaatatccgggtttttaggcgaatatgtagatgccgtagcgattatggcgattgtatttgtcaatggggttctcggtttttttcaagagcggcgggcggaaaagtctttacatgcattaaaagagctgtcaacgccgtatgtgtcagcgttgcgggacgggagctggaagaaaattcagtccaaggagctcgttcccggcgatatcatgaaattttcaagcggcgaccggattggcgcggatgtgcggatcgttgaagcgaaaagccttgaaattgaggaatcggcgctgaccggggaatcaattccggtggttaaacaagccgataaattgagaaagccggatgtttcgttaggcgacatcagcaatatggcgtttatgggtacgatcgtaacgcgcggcagcggtgtcggcgtcgtcgtcggtacaggaatgaatacggcaatggggaaaattgccgatatgctggaatccgccggcagcctttcaacaccgctgcagcgaagacttgaagagctcggcaaaattttaattatcgtcgcgctccttttaacggtattggtcgttgcagtcggcgtcttacagggacatgatctttacagcatgtttttggccggggtgtcattggccgtcgccgcaattccggaagggcttcccgccattgttacggtggcattatcaatcggcgtccagcgcatgatcaaacaaaaatcaattgtcagaaagctcccggcggttgaaacattgggctgcgcctctgtcatttgttctgataaaaccggcacgctgacacaaaacaaaatgaccgtcacccatatgtggtcaggcggcaaaatttataaagtgtcaggcatcggctatgtgccggagggcgttttcacccgagatgagcgggaaatcaagccgaaagatgagaagattcttgaacagatgctggttttcggcgcgttgtgcaacacatctgaaatcgcactgaaagacggccgttatgtactcgacggtgatccgacagaaggagcgctgctgacggctgcaagaaagggcggctattcaaacgattggctcagcgggcattaccgcgtggttgccgagtttccgtttgactccgtccgcaaaatgatgaccgtcattgtagaggatcaggaaaaaaagcagttcgtcatcactaaaggagcgcccgatgtgctgattgaccgctcgtcacatctgatgcacggcgcaagaagtacgcctttttcaggagaaaagaaagcagaaacggaagcggttctgaaagagctggcgtcgcaagctttgcgtacgattgcgattgcttataaaccgcttaagcccggagaaaagccgacaatggagcaggcggaaaaaaatctgacgatgctcggcttgtcaggcatgattgatccgccccgtccggaggtcagacaggccattaaagaatgccgtgaagccggcattaaaacggttatgatcacaggggatcacgtcgaaacggcaaaggccattgcaaaagatttgcgtcttcttccgaaaaaggggcgtgtgatggacggcaagacgctgaatgagcttacggacaaagaacttatcgaaacggtcgatgatgtctacgtcttcgcacgcgtgtcacctgaacataaattgaaaatcgtcaaagcgttccaggaaaacggacacgtcgtcgccatgacgggagacggggttaatgacgcgccggccataaagcaggcagatatcggtgttgccatgggcgtgacgggaacggatgtggcaaaggaagcctcttctctcattctggtagatgataactttgctacgattaaatcagccataaaagagggacggaatatctatgaaaatataagaaaattcgtccggtatttgctggcctccaacgtcggtgaaattttagtgatgctgtttgcgatgcttctcgctctgccgctgccgctcgtcccgattcagatattgtgggtgaacttagtcactgacgggctgccggcgatggccctcggtatggatcagccggaaggagacctgatgaggcggaagccgcggcatccgaaagaaggagtgtttgcgagaaaactgggctggaaagtcgtatcaagagggtttttaatcggagccgcaaccattttagcgtttatcatcgtctatcaccgcaatcctgaaaatctgccctacgcacagaccgttgcattcgcgactcttgtcctggctcagcttatacacgtgtttgactgccggagcgaaacgtctgttttctcccggaatccgtttgaaaatatttatctgctcggcgccatcgtttcttctgtcttcctgatggccatcgtcatctattatccgccgctgcagccgattttcaaaacagtgccgattacgccgggcgattggatgctgattatcgggatgtctggcatacctacttttttgctggcgggttcacttttgacaagaaaaaaataattccatatgatataatcttaggggtaatagcatgtctattgcccttttattttgataacgggaaagaattgggtgtttcatatgatacggagtatgacaggcttcggcagcgcaagcagcacaaaaggcgatctctcggcaaccgttgaattgaaatccgtcaattaccggttcaaagaagtgaacgcccgcctgccacggcctttgctatatgtagaggataagctgaaacaaacgatattgcagcatatacagcgcggaagagtagagctgtttctcactgtcaacagtgacgcgctcataaaaagaagcctgaacatcgattgggagctccttgatgaatatgtgagcgccgcacgcgccatgaaagagcgctacagcctggccgcagaacccgatgcaatggatttctttagatttgaacatattgcgcagattcacgaagaacagatgcgtgatgacaagcttgaagaagtcatcagggaagccgctgagctggctgtaaaggaactttgtgacatgagggaaaaagaaggccggcttttggcggaagactgctttctgcacattgagcggcttgagacgctgtccgaacaggtgaaagagcgcgcttcggccgttgttattcaataccgcgagcgtctttacgcccgaatgaaggaatggacggaggacgcgctcgacgaaagcaggctgatcacggaatgcgccattttcgccgatcgttctgatataacggaagaaattaccagattgaagagccattttgttcaattccgtgatatattaaaagaaggcggggcagtcggccgcaaacttgatttccttgttcaggagcttaaccgggaagcgaacacgatcggctcaaaagccaatgatcatcaaatcacaaagcttgtcgttgaaatgaaaagttctattgaaaaattgaaggaacaagtgcaaaatatagaatagcgactgtgcgtattgtttacagacggtctcttcaggttacactagagacgtctattttacagggggaacgtagaagatgacgattaaactgattaatatcggatttggcaatatcatctccgccaatcggatgatttcgattgtcagcccggagtctgcgccaataaagcgaatgatccaggatgcaagagaccgcggaatgctaatagacgctacatacggacgaagaacccgtgcagttgtcgtcatggatagtgatcacattatcttatctgccgtccagcctgagacagttgcacacagactttctgtgaaagaagaaattatggatgaagggcaggggtaattgccgcatgaaagaaagagggttattaatcgttctctcaggtccctccggagttggaaaaggaacggttcggcaagcaatattttcacaacaggacacgaaatttgaatactcaatttcagtcacgacgagaaacccgagagagggcgaggtcgacggcgtcgattatttctttaaatccagagatgaattcgagcgcatgattgaaaacaacaaactgcttgagtgggcagaatatgtcggcaactattacggtacgcccgttgattatgtcgaacagacgcttcaagaaggaaaagacgtcttcttagagattgaagtgcagggcgcgctccaagtgcggaatgcatttccggaaggcctgtttatcttcttagcgccgccgagtctttctgagctgaaaaacagaatcgtgacaagagggactgaaaccgacgatttaatcgaaaacagaatgaatgccgcaaaagctgaaatcgaaatgatggacgcgtatgattatgtcgttgaaaacgacgatatccaaacggcttgtgataagattaacgcaatcgttctcgccgagcacttaaaacgtgaacgcgttgctccgagatataagaaaatgctggaggtagaataacttatgttagatccgtcaattgactctttaatgaataaattagattctaaatatacgctggtgactgtgtctgcaagacgcgcgcgtgaaatgcagatcaaaaaggaccagcagattgaacataccatttctcacaaatatgtaggcaaagctttagaagaaattgacgcgggcctgctttcgtttgaaagagaagacagcgaataacaagcacacgtagcaacctatctctacataggttgttatttttttccgtttgggatttgtccaatgctttcataaaggaggagaagacttcatgaaaaaccgaaacattttgctatgcgtaagcgggggaattgccgtttataaagcttccgcactcacgagcaagctggttcaggccggcgcaaatgtcaaagtgattatgactgagtccgcgcgtgagtttgtttctccgctgacatttcaggcgctgagccggaatgaagtgtatacagatacatttaatgaacaaaatccgaaggtgatttctcatattgatgccgctgactgggcggatttaattattgtcgcgcccgctacggcaaatattatcggcaagcttgccaacggaattgctgatgatatgctcacaacgacggtgctggcggctgaggccccggtctgggtggcgcctgcgatgaatgtccatatgtatgatcatccggcggtgaaacggaacatctctgtgctttatcaggacggggtccgctttatcgagccgagtgaaggctatttggcatgcggatatgtcggcaaaggaaggctggaggagccggagcttattgttgagcgtgtcagagagcattttaaggagcctgaagacgatgcgccgctgaaaggaaaacatattgtcattacggccggtccgacgcgcgaagccgtggaccctgtccgcttcttcacaaataaatccaccggcaaaatgggctacgctgctgctgaagccgccgtccgtctcggggcgcgggtgacgctgatttcaggcccggtgtcaatagagccgccagtcgggctgtatcagtttcttcctgtgcaatcggcagccgatatgagagaagccgtgctttctgtgtttgattcatgcgacatggtgattaagacggcggccgtggccgattttacgccggcggctgtttctgatcacaaaatgaagaagaaagacggttcgctcgtgatcgaattcaaccgtacggcagacatactgaaagaactcggcgaacggaaaacacaccagctgctggtcggatttgcggctgaaacgcaagacgtcgaacgctatgcgcgcagaaaactcgaacagaaaaaccttgatatgatcgttgcgaatgatgtgaaagcggaaggggccggatttggcacggatacgaatgtcgtcaccttctatttccgggacggaagaaaacgggagcttgcgcttatgtctaaacttgacgtttcctttgaaatgctgaaggaaatgacagctttgaaagccgaggaccgaaaacccgtatgaatgtagcagaagtcattgtcgatgtcagctccaaaaacattgacagaccctttgattacaaaattcccgatcatttaaaagggatgatcgaagtcggcatgcgggtgattgtcccgtttggcccgcgcaagcttcaaggatttgtgaccggtttgaaagattcgtccgaattaaacggcggctcaatgaaggaagtcgagaagcttcttgatttgacgcctgttctgactgaggaactgatgcagctgtcttcatggctttctgacaaaacgctgtcgtttaaaatcacggcgcttcaggcaatgctgcccgccgcattgaaggcgaagtacgagaaagagctgaaagtcgttgacgaagaagcgctgacaccggacatcaaacagcttttcaggaatcaaaaaagtcttctgtactcggatattaccgatgaaagcattctttcgtcacttcagaaattcgtgcgtaaaggaagcattgatgtcacatataaagtcgcccaaaaaacgaataaaaaaatgatccgcatgattgaagcgggggcagacaaagaagaactcgcccggcacgcagattcattgacaaagcaggcttctaaacagctcgccgtgcttacttattttatcggcgggggagaaaagatttccgcggctgaactttgcaaaaagaccgattccagttccgcgacgctgaaaacgcttcttaaaaaggggcttcttacggaaagctttgaggaggtttaccgcgatccttatcaggacagaatgttcaaaaaaacagagccgctctctcttacagaagagcagcaggccgcttttgagccgattaaacaagctgtagccgaccatgtccatcacgtctttctgcttcacggcgtcacgggaagcggcaaaacggaaatttacctgcaatccattgaaaaagtgctggcaaaaggacaagaagccatcgtgctcgttccggaaatttcgttgacaccgcaaatggtcaaccgttttaaaggccgcttcggctcacaggttgcggtcatgcacagcggattatccacaggtgaaaaatacgatgaatggcggaagattcagcgcaaggaagtccggcttgtcgtcggagccagatcggccatctttgccccgtttgaaaatctcggcatgatcattattgatgaagagcacgaatcttcctataagcaggaggaaatgccgcgatatcatgcgaaggacgtagccatccgccgggccgagcatcacagctgtccggtcgtcctcgggagcgccacgccgacattggagtcatttgcgcgggcgaaaaaaggcgtttatgagctgcttccgttaaaacatcgcgtaaaccgccagctcatgcctgacgtttctctcgttgatatgagagaagaactgagaaacggcaacagatcaatgttctcaagagagctgatggaacagctggaagagaagcttgcaaaaaaagagcaggccgtcctttttctgaataaacgggggtattcctcgtttgtgatgtgccgggactgcggttatgtgccgcaatgtccgcattgcgacatttccatgacttatcaccgctacggacaaaggctgaaatgccattactgcggccatgaggaacctgtcccgggaacatgcccggaatgcggaagcgaacatatccgctttttcggcacgggaacacagcgtgtggaggaggagcttaccaaagtgctgcctcaggcgcgcgtgatcaggatggatgtggacaccacttcaagaaaaggcgcccatgaaaaactgttgtcagcgttcggtgaagggaaggcggatatcctgctcggtacgcagatgatcgcaaaagggcttgattttccgaacgtgacgcttgtcggagtattaagcgccgatacgacgcttcacatcccagatttcagggccgcggagaagacattccagctgctgacacaggtaagcggacgggccgggcggcatgaaaagccgggaacggtggtcattcaaacgtatacaccgtctcattacagcattcagctgacgaaaacgcacgactatgaaactttttttcagcaggaaatggcgcacagacgggcccagtcatacccgccgtattattacgtggcgctggtgaccgtttctcatgaagaagcggcaaaagccgcggtcaccgcagaaaagattacaaactatttaagagcgggatgcgggcctgatacgaaaattctcgggccggcggcttccccgattgccaggatcaaagatagatatcgctatcaatgcgtgataaaatacagacaggaaaacgagttgcagattcagttgaaaaagatactggagcactataaacgcgacattgcgcaaaagcatgtaatgatttcaattgatatgaatccgtacatgctgatgtaacattagtttttggagggcaaaattttggctgtaaaaaaaatcgtcacacacccggcggaggttctggaaacacccgccgatgaagtgacagtgtttgataaaaaattaaaaaaactgcttgacgatatgtacgatacgatgctcgaaatggatggcgtcggtctcgccgcgccgcaaatcggcattttaaaaagagcggccgtcgtggacatcggtgaagaaagcggccggatcgaccttgtaaatccggttattcttgaaaagagcggtgaacagaccggagtcgagggctgcttaagttttcccggggttttcggtgatgtcacccgcccggattacgtaaaggtaaaagcccacgaccgtaaaggaaaaccgtttattttagaagcggagggttttttggccagagccgttcagcatgaaatggatcatttagacggcattttattcacatcaaaaattacggcttactacactgaagaagaactggcagaaatggaaggatgattggatgacaaggatcgtttttatgggaacgcccgacttttcagttcccgtcctgcgcacgcttattgaagacggatatgaagtggttggtgtcgttacgcagcctgaccgcccgaaaggcagaaaaaaaatcatgacgcccctcctgtaaaggctgaagctgaacgtcacggcattcccgtgcttcagcccgaaaaagtaaggctcgaagaagaaatagaaaaagtgctaagcctgaagccggacctgattgttacggcggcattcggacagatcctgcccaagcagctgctggacggtccgaaatacggctgtatcaacgtacacgcgtcactattgcctgaattaagaggcggagcgccgatacattattcgattctccaaggcaagaagaaaacaggcgtgacgatcatgtatatggttgaaaagcttgatgcgggcgatatgatttctaaaatcgaagtggaaattcatgaaacggataacgtcggcacgctgcacgacaaattaagcatagcgggggcaaagcttttgtcagagaccgtcccgaacgtcatctccggaaatattaaaccgatcaaacaggacgaatcaaaagcgacttacgcgcctaacattaagcgtgagcaggagcggattgattgggcaaagcccggagaagagatctacaaccagatcagaggtttaaacccttggcctgtcgcctatacaactttgaacggtcaaactattaaagtatgggcttctgaaaaagttgcggcaaaaactgatgctgcgcccggaacagtcatccgcacggagcaaaacggcattgtcgtcgcatcaggaaacagcaccgcccttttaatcactgagctgcagccggcggggaaaaaacggatgaagggcgaagattttgtaagaggcaaaaatgtgcagcccggtgacgtgttaggagcagcaaatgaagaaaattaatgtccgggagctcgcccttgaagcgcttgagaagcttgagcaaaatcaggcatacagcaacctgcttcttacatcggttatcaaaacgaacacgctcagcgatcaggacagaggactgctgacagagcttgtctacggaacgctgcaaaataaaatcgccttagactatatgctgaagccttttatccgcaagccgaataaggtgaagccgtgggtgattcagctgcttcgtctgtccgcgtatcaaatggagtatttagaaaaaattccggatcgcgccgccatccatgaagcggttgaaatcgccaaaaaacgcgggcataagggcattgcgtcctttgtcaacggcattctccgctccctgcagcgtgagggggcgccgtcatttgctgaaattgaagacccggttctccgtctttctacagagacaagccatcccgaatggctcgtaaaagagtgggtcgaggcgtacggctttgaggcggctgaaaaaatctgccggattcatctcattccgccgaagcagacgctccgtgtcaatcacataaagagcgacagggaaacggtgctgaatgagatggagaatgccggtctggaagcggaagccggagacctttctcctgatgcgattaagcttttgaaaggaagcatcgcgaacacggcatttttccaaaacggccgggtatccatacaggatgaaagctcaatgcttgtcgcccgggcgctggacccgaagccgggcgaaaccgttttagatgcatgcgccgcaccgggcggaaagtcggctcacattgcggaactgatggagaacgaggggagcctcacatcgcttgatcttcaccgtcataaagtgaagctgattaaagagggcgcagaacggctcggtcttacgatcatcgacgcgcaaacgatggatgcgcgaaaagcgggagaggcctttggcgcagaacggtttgaccgtattctcgttgatgccccttgctcaggtttcggcgtcatcagaagaaaacccgatatgaaatatacgaagacgccggaggacagcagacggctgtcagaaatccagctcggcattttaagggaaatcgccccattagtaaaaaaaggtggcacactcgtatacagtacgtgtacaatggatcggacagaaaatgaagaagttatgcatgcgtttatacaagaacaccctgagtttgaacccgatttgtctcttgaaaagcggctgcctgaaaaggcgagaccctttgttcaggatggaagccttcaaattcttccgcattatttcggaacagacggtttctttattagcagcatgagaaagaagggataaaaatgacacaattaaaaaagacaagcgtacggaaagagctgcggactgagcagccgtccatttactcttttgaattagatgaaatcaaacaatggctgaccgagaatggcgaaaagccgttccgcgcagcacagatttttgaatggctctatgaaaagcgggtttcttcatttgatgaaatgacgaacctctcaaaaagcctgcgtgaaaaactcgagagcaattttgtgctgacaacgctgaaaacggctgtaaaacagacatctcaagacggcacgatgaaatttttatttgagcttcatgacggttatacgattgaaacggttttaatgagacacgagtatggtaattctgtatgtgtaacgacacaggtcggctgccggatcggctgcacattttgcgcgtcaacgctcggcggtctgaaacggaatcttgaagcgggagaaatcgtcgctcaagtcgtgaaagtgcaaaaggcgcttgatgaaacggatgaacgcgtcagctcagtcgtcatcatgggaatcggagagccgtttgataatttcaatgaaatgctcgctttcttaaaaatcattaaccacgataaagggctgaacatcggagcgcgtcatatcacagtttccaccagcggaatcattccgaagatttacgatttcgccgatcaaaaaatgcagatcaatttcgcgatttctctgcatgctccgaatacggaaatcagaagccgtctgatgccgattaacaaagcctataagcttcctgaccttatggaggccgtcaaatattacatcgagaaaacaggcagacggatcagctttgaatacgggctgttcggcggcgtaaatgatcaggtcgaacatgcagaagagcttgcagaactgttaaaagacgtgaaatgccatgtcaatttaattccggtaaactatgtgcctgaacgggattacgtccgcacaccgagagatcagattttcgcattcgaaaaaacgttaaaatcccgcggtgtaaatgtcacgatcagaagagagcaaggccatgacattgacgcggcctgcggtcagcttcgcgcgaaggagcgtcaagacgagacgaggtgaagaggttgattacagccttgaaaacagatacaggtaaagtccgccggcataatgaagatgcggcgggcattttcacaaaagaagacgcggtgcttgcggttgtcgccgacggcatgggcggtcatcttgccggagatgtagcgagcaggatggcggttgcggcgatggaagagcagtggaaccggaccgaaacggttccttctctgccgtccgcttgcgaggattggctgaaagaccggattcatgaggcgaatgtcaaagtgcatgaccacgctaaagccaatgaagaatgccggggaatgggcaccaccattgtctgcgccttattcacggggaagtttgtcactgtggctcatattggtgacagccggtgctacctgcttcaagagggggaattcactcagctgactgaggaccattcgcttgtgaatgagctggtcaagacgggggagatttcgaaagaggacgccgagcaccatccgcggaaaaatgtattgacgagagcgctggggacagatgaaaccatcagccccgacgcccgttcttttgaactgtctgacggcgatcagctgcttttatgctctgacggactgtcaaataaaatagaagatcacgagatcaaacaaatgcttcaagccgaatctgatcatcaggaaaaagtagaccttctcatcagcaaagcaaatcaaaacggcggcgaagataacatcacggctgtgttgattgagttttccgcagatgcaaaagagggtgaagacaagtgctaaccggcaagcggatcagcgggcgttatcatatcctccggcccattggcggcggcggaatggcaaacgtttttttagctgaggacatcattctcgaacgtgaagtcgcaattaaaattctgcggtttgactttgtgaatgacattgattttatcaggcgtttcagaagagaagcacagtcggcatcaagcctcgatcatccgaatatcgtcagtatttacgatatcggggaggaaggcgatatttattacattgtcatggaatatgtggaaggcatgacattaaaggaatacataaacgcacacggaccgcttcatccgaaagaagcgctgtccgttatggagcagatcgtctcggccatcgcccatgcccatcaaaaccatatcgtgcaccgggatattaaaccgcacaatatattgatagatcatttagggcatatcaaggtgacggatttcggcatcgccacagcgcttacgtctacgacaatcacacatacgaattctgtgctgggctcggttcattatttgtctccggagcaggcgagaggcggtctggcaacgaaaaaatcagatatttacgcgctcggcatcgtgctgtttgagcttttaacaggcaaaatcccttttgacggagaatcagccgtcagcatagcgctaaagcacctgcaaacagaaacgccttccgccagaaagtggaacccttccattccgcagagcgttgaaaacattattttaaaggcaaccgccaaagacccgtttcaccgctatgaaagcgccgaggacatggaggcggacatcagaacggcttttgacgccggcaggctgaatgaacaaaaattttccgtgcaggatgatgaggaaatgacaaaagccattcccgttattactgacggcccaaaagccgcgtctcaggcggaaacgccgggggagacggatgataaggaacagcagccagccaaaaagaaaaaacggaaatggccgtgggttttgctggccgtctgtttcatttttattatggcggctgttcttgcggtcaccgtgttcccgtctttatttatgcctaaagatgtaagcgtccccgacgtacggggcatgaagtacgaaaaagcggaagccctgcttgaaaagaacgggctccgggctgatcctgatataacggatattgaagatgaaaaaatagaagaggaattaatggtcaaaacggacccaaaagcggggtctaccgttaaagaaggctcttctgtaaaactgtacaaaagcatcggaaaaccgaaaacccagctgatcgacgtgaaaggacggcagatcggcgacgcaaaaaaagcgctgaaggaaaaaggtttcaaacatgtcaatgtcaaagaagaaaacgatgacagcgaggccggcaccgtaattgatcaggacccgtcagccggcaccgatatggtcgcaagcgatgatgaagtcaatctaacggtcagcctcggcccggcggacgttacgctgagggacttaaagacttacagcaaagaagcggcttcagggtatcttgaagataacggcctgcagcttgttgaaaaacaagcccattcagatgacgtgccggaaggacaagtcatgaaacaagagccgtcagccggcactgcggttaagccgggaagtaatgttgaagtgacgttctcgctcggacctgaagaaaaaccggcgaaaacggtaaaagaaaaaatcagcattccttacgaacccgaacatgaaggggaagagcttgaagtgcaaatcgccatcgatgataaggaccacagcatctctgatacgtatgactcatttaaaataaaagagccgaccgaaaaaacaattgaactgaagattgatcagggacagaaggggtattatcaagtgatggtcgatcataaagtcgtcagctacaaaacgattgaatacccgaaagataatgactgataaggagggaccctatgcctgagggcaaaattataaaagcgttaagcggattctattatgtcttggatgaatcacaggacaagatcattcaatgcagaggccggggcattttcagaaaaaataaaataacgcccctggtcggcgattatgccgtttatcaggctgaaaatgataaagaaggctacctgctggaaatcaaagaacgaacaaatgagctcatcaggccgccgatttcaaatgtcgatcaggccgttctcgtcttttctgccgttcagccggcgttcagcacgtctttattggaccgttttctcgtccttgtggaagccaacggcattcacccgatcatctgcataaccaaaatggacttagctgcagacggggaatcgaaagaggcgatactttcttacgtgaaagactatcaggcgatcggttatgacgtatatgtgacgtcatcaaaagaaaacagcggcttaacaggcattgtgaaacacttcgaggacaaaacgacggtgtttgccggtcagtccggagtcggaaaatcttcgcttttaaatgcgatcagcccggagcttgagctgaaaacaaacgagatttccgcgcatttgggacgcggaaaacatacgacgcgccatgtggagctcattcatacatcaggcggtctggttgcggatactccggggttcagttcgcttgaatttaccggcattgaggaagaagagctgggcagcacgttccctgagatcagagaaataagcgcctcctgcaaattcagaggctgtctgcatcttaaggagccgaaatgcgcggtaaagcaagcggtggaagaaggagagattcagccgtaccgctacgagcattacaaagaatttatgcaggaaataaaagagagaaagccgaggtattaatatgattaaggttgcgccatcaattctttccgccgattttgcttcactgggcgaggaaattaaagacgtggaaaaaggaggggcggactatatccatattgatgtcatggatggccatttcgtccctaacattacaatcgggccgcttatcgttgaagccgtccgtccggtgactgatctgccgctggatgtccatcttatgattgaaaacccggaccgctacatcccggcattcgcaaaagccggtgcggacatcctttccgttcacgctgaagcgtgtccgcatcttcaccggaccattcaattgataaaagagcagggggtaaaagcgggagttgtgcttaatccgcatacgcccgtccaaatgattgaacatgtgatcgaggagcttgaccttgtgctgttaatgacggttaaccccggttttggcggacagcgcttcattcattcggttctgccgaaaatccgtcaggtcaaacagctggctgaggagaaaggcctgtctgagcttttaatcgaggtggacggaggcgttaataaagaaacagcccctttatgcgctgaagcgggcgccaatctgcttgttgccgggtctgccgtatataatcagccggatcggaaaaaagccatcgctgacatccgaaacgcatcataaacatgctgaaaaagagcccggtgaaagccgccggctcttttcgcgtctaagagagaggatagcatatgaagacaatcaatatcgttgcgggcggcccgcgggagcttattcccgatctatccgaatacacagacggagatacgacgtgggtcggagttgataaagggacggttgctcttttggaggccggaatcattccgcaggaagctttcggtgattttgacagcattacggaagaggagctcatgcagattcaaaaagcggcgccggccctccatgtgtatcaggcggaaaaagattataccgatcttgaactcgcccttgactgggctttacaaaaagaaccggaaaacattcgggtattcggtgtgacgggcggaagagccgatcactttttagggaacatccagctgctgtataaagccttacataagcataccgatgtcaagctgatcgaccggcagaatgacattcagatgttcgggcccggccgttatacaattgaagaaaaagcgcgcagacgctatatttctttcattccgtttacggaagcggcagacggcctgacactcgacggttttaaatatccccttgataattgtcatattcctctgggttccacactatgtattagtaacgaactcattcattcacgaggtactttttcgtttgcaaaaggcatattaataatggtaaggagcgcggattagaaaagcggcttctgccatatgcggaaaaaaccatgaatcctaaagtgatgaacgcagcggatacgggacttataggaggggacaaaatgaaattttataccattaaattgccgaagtttttaggaggaattgtccgggcgatgctgggctcatttagaaaagagtaagcccaagaagctgaaatcgccctctttgaacgcataaaaaacgcctgccgcataaaagggcaggcgttcatttttgcttatacacgctcaactttaccggattttaaagcccgggcagatacatacacttttttaggtttgccgtcaacgaggatgcggaccttttgaaggttggcgccccaagtacgcttagaagcgttcattgcgtgagaacggttgtttccggcttttgtttttttacctgtaataaaacatttacgtgccatttgtttccctcctaactgcgcgaaacatctttttaaacatagtgtctcagatgctttcgttatacaatactttaaataatttaccacagctaaaaaccgtttgcaactattgtttcccttactttcaagaaaaatcacttgacatgtaaaaccaatcacatttccgcgctgaaggccgctgtctgtatcttttcttttcataatgggatacatatagtagaataatgataactctatgcacctgaaggaggaacctgtgtgtccattgaaatgaagacaaaatacggacagattgatatatccaacgaagtcatcgcaatggttgccggaggcgctgccattgactgttacggaatagtggggatggcctcaaaaaaccagattaaagacggtttgtctgaaatcctccggagagagaacttcgcaaaaggcgtacatgtccgtcaggaagccgaacaaatacatatcgacatgtacattattgtcagctacggcactaaaatatccgaagtagcccacaatgttcagacgaaggtaaaatacacagtaaatcaaacaatcggacttgcagttgattctgtaaatatttatgtccaaggcgtacgagtaacgaacccgtagtgaggaggatgagtattgtctagacgaaacttagatgggagagcttttgcggcaatgattctggcgggggctgagacattgtctcaaaacgcatccgcggtggatgcgctgaacgtgtttcccgtgcctgacggcgataccggaacaaatatgaatttatcgatgtcatccggtgcaagagaggtagagcacattgactcacccgacatcggcaaagtcggcatcgccctgtcaaaaggcctgcttatgggagcgagaggaaactcaggggtgatcttgtcccaattgttcagaggtttcacaaagagcattgaaaacaaaaaccaaattgatgcccaagagtttgccgcagcactccaagcgggagtggatatggcatataaggcggttatgaaaccggttgaaggaacgattttaaccgtggccaaggatgcggctaaaaaagcggtcgcctcggccaaagaagaaaccgatattatttcagtcatggaggccgttattgaagaagcggaagcgtcgctcaaccgcacgccggatctgcttcctgttttaaaggacgtcggtgtcgttgacagcggcggaaaaggtctgctttgtgtatatgaaggctttttggctgctttaaaaggagaggccgtaccgaaaaaagcggttcttccggcactcgatgatatggtgaatgccgagcatcataaaagcgcgcagagcatgctgagtacagaagacattgaattcggattttgtacggaagtaatggtgaggctggatcaagataaacggacgttcaaggaagaggcgttcagaaacgaactgagccgtttcggcgattcattgctggtcgtggctgatgatacgctggcgaaagttcatattcatgccgaagaacctgggaacgtactcaatctcgcacagcgttacggcgatctgattaaaattaaaattgaaaacatgagggaacagcatacttcaatcatcagccaagaacatgatgaaaaaaagccggccggcgttatgaaagaagcccgcaagccttttggcatcgtgactgtggcaatgggagagggcatttctgaattgtttacgagcatcggcgcttcacacgtaatcgaaggcggccagacaatgaatccgagcacggaagatattgttgaagccgttcagtctgtcaatgcggagacggttttcattcttccgaacaattccaatattgtgatggctgccaatcaggcggcgagcgtagctgaagaaaatgtcattgtcattccggcaaaaacggtccctcaaggcatgaccgccctgcttgcgtttaaccctgaccagccggctgatgtaaatgaagccaatatgcttgaggccatccggaatgtgaaaagcggacaggtgacatattcagtcagagacacccatattgacggcaaagaaattaaaaaaggtgattttatcggcattttaaacagttcaattatcggcagcgccgaagatcggataagtgcggcgaaattgctgctggatgaaatgatcggggaagaagatgaaatcgtcaccatcctgtacggagaggacgcgccggaagaagaagctgagaaactcgctgagtatattgctagcgtctgtgaagatatcgaggttgaaatccataacggcagacagcctctgtatccatatatatttgcggcagaatagaagggcttatcaggcccttctattcttatgcctttatttacctgcggcagtgcggcagtgtgcctgcttgccaattgagaaatgttcaattagtctaaagaaaagcgctgaatgaagtgatgttaaggaggagcaaaccagcatgaagtatagaagcgtttttgatattatcggcccggtcatgatcggtccgtccagttcacataccgcaggcgccgcccggatcggcagagtggccagaagcttattcaggcgtgagccccgccggatcgttgtgtctttttacggatcatttgcagaaacgtataagggtcacggcactgatgtcgcgattatcggcggcctgcttgattttgatacatttgatgaacggattaaaacagcgattcaaattgcggaagagaagggcatatatgtagagttccgtacagaggatgccgtgcccgttcatccgaatacggcgcgtatcgtcatttctgatgatgagggagagcttgcccttaccggtatttccatcggcggcggaaaaatagaaatcacggagcttaacggctttgagctgcgactttccggaaaccacccggctattttagtcgttcacaatgataaattcggcacgattgcaggcgttgccaatgtgcttgcgaaattctccatcaacgtcggacatatggaagtggcgcgtaaggacgtcggccagcttgcgctgatgacgattgaggtcgatcagaatattgaagaagaagtgcttgacgagctttcaacacttcctaatattatacaggttactaagatagctgactaaaaagtcaggaggaaaatgacatgtttcgtaatgtaaaagaattaatagaaatcactcaagaaaaacaaattccgatttcggaagtgatgatcacccaagagatggaagtgacgcaaaaaacacgagaagaaatctttcaaggaatggagcgcaatctctccgtcatggaagcagctgttgaaaaagggctgaagggcgtcacgagtcagaccggtttaacaggcggagatgccgtgaaacttcaggcatacatccaatcgggaagaagcctttcgggcaatctgattttagacgccgtttctaaagctgtggcgacaaatgaagtcaatgcggcgatgggaacgatctgcgctacaccgaccgccggctctgccggggttgtgccgggaacgttattcgccgtaaagcataagctgaaccctacgacagaacaaatgatccgttttctgtttacagccggcgcgttcggttttgtcgtagcaaataatgcgagtatttcaggagcggcaggaggctgtcaggcggaagtcgggtcagcatcaggcatggcagcggccgcgattgtggaaatggcgggcggaacgcctcagcaatcagcggaagcaatggcgattacactgaaaaatatgctcggtctcgtatgtgacccggtcgccggattggtagaagtgccgtgtgtcaaacgaaacgcaatgggagcatccaacgcgatgatcgcggcggatatggcgctggccgggattacaagccgcattccttgcgatgaggtgattgacgcgatgtacaaaatcggccagacaatgccgacagcactgcgtgaaacgggacaaggcggtttagctgcgacaccgacgggaagagaattagagaaaaaaattttcggaggagcgctgaaatcaagtgacacaccatcagcaaactagtatagcggaaattaagggcattgggccggaaacagaaaaaacattgcacgaacttggtatctatgacatttctgatcttctgaattatttcccttaccgttatgacgactatgagctgagggatttagaagaagtaaaacatgaagaaagagtgacggtagaagggaaggttcattcagaaccttctcttacctattacggcaaaaaacgaaacaggctgacattcagggtgcttgtcggcaattatttaattaccgcggtctgctttaaccgtccctacttaaaaaagaaactgacgttaggttctgtcgtcacgatatccgggaaatgggataaacacagacagaccgtttccgtgcaggaattaaaaaacggtcctcatcaagaagataaaagcattgagcctgtttattccgttaaagaaaacgtcaccgtaaaaatgatgagacggtttattaaggaagcgctgcagcatcatttggacagtgcggccgatccgcttcctgaaaaattgagaatccgctataagctgcctgattacaaacatgccctgcagacgatgcatcagcctgaaacgagggaatcgttacagcaggcaagacgacggtttgtttatgaggaattcttattatttcagctgaaaatgcaggcgttccgtaaagcggaaagggaacagtcaaaaggcatcagccatgtgtttcctgctgaaaagctcaccgctttcacagacagcctgccgttttcgctcacgaccgcacagacgcgcgtgcttcgggaaattaccgctgatatgacatccccttaccgaatgaaccgtctgctgcaaggtgatgtcggttcagggaaaacggccgtcgccgccatcgctttgtacgctgcgattctgtcggggcatcagggggcattaatggtgccgactgaaattctggccgaacagcatgcagattctctcgtatcgttgtttgcaaatgaagatgtaaatatcgcgcttttgacgagttctgtaaaaggaaagcggcgcagggagcttttggagcggcttgctctcggagagattgatattttagtagggacccatgctttaatccaggatgaagtggaattcaaagcgctgagtcttgttattacggacgagcagcaccggttcggggtcgaacagcgcaaaaaactcaagaataaaggtcaagatccggatgtgctgtttatgacagccaccccgataccgagaacgttggccattaccgtcttcggagaaatggatgtttccgtgatagatgaaatgcccgcggggcgaaaacaaatcgaaacgtattgggtgaaacacgacatgctggagcggattttggcttttatagaaaaagagctgaagcagggaaggcaagcctatattatctgcccgctcattgaagagtcggataaactggatgtacagaatgcgattgacgtatataacatgctgtctgacgtttaccgcggtaaatggaatgtcggcctgatgcacgggaagctccattctgatgaaaaagatcaagtgatgagagaattcagcgccaatcaatgtcaggtacttgtgtcaacaaccgtcgtagaagtcggggtgaacgtgccgaatgcgacgattatggtcatctatgacgccgaccgtttcggattatctcagctccatcagctccgcggccgggtcgggcggggagaccaccaatctttctgcatcttgatggccgatccgaaatccgaaaccgggaaggaacggatgagaatcatgtcagagacaaacgacggcttcgagctgtctgaaaaggaccttgaactgcgcggccccggtgatttcttcggaaaaaaacagagcggtatgcccgagttcaaggtggcggatatggttcatgactacagagctttggaaacggcccgccaggatgcggccaatctggtgtcttcagaggctttttggaaagatgacgaataccgcatgctgcgcggtcaattactttcaagcggcgtcctagaaggggagaaattaagctgattctgtaaaattcggcggctttcaaaaaacaatcattgcattccaatctatgagattatatactactattagtacctagtcttaattgtccggatggtgtttacagatgagaagaagcaagaaagaacgccaaaaattattgcagcagacgatcaaatcgacacccttcatcacagatgaagaattagcggggaaattcggcgtcagcattcagacgatccgtttagaccgcttagagctctcaataccggagctgagggaaagaattaaaaacgtggcagaacaaacgcttgatgatgaagtgaaatcattgtctttagacgaagtgatcggtgaaatcattgatctggagcttgacggccaggccatttccatattagaagtaagacgcgaacatgtcttcagccgcaatcaaattgcgcgggggcatcatttgtttgcgcaggcgaactcactcgccgtagccgtcattgatgatgagctggcgctgaccgcaagcgcaaatatccgctttacaagacaggtgaaagaaggcgagcgcgtcgttgcgaaagccaaagtgacggcagtcgaaaaagaaaaaggcagaacggtagttgaagtcaacagctatgtgggagaagaagtcgtgttctccggcagctttgacatgtaccgttcaaaacaatcataaaggtggagcatgcatgagaatagctgtagatgcaatgggaggcgacaacgcacccaaagctgttattgacggagtaatgaagagtattgaggcatttgacgatcttcatattacgctggtcggtgacaagacaacgatagaatcacacttgccaacaacatcagaccgcatcactgtgttgcacgccgatgaagtgattgaaccgacggatgaaccggtccgcgccgtacgcagaaagaaaaactcttctatggtgctgatggcgcaggaagtggctgaaaacagagcggacgcctgcatctcagcggggaatacgggcgcactcatgacagcgggactgtttatcgtcggcagaattaaaggaatcgaccggcctgcgcttgcgccgacgcttccgaccgtttcaggcgacggtttccttcttttggacgtgggagccaatgtcgatgccaaaccggagcatctcgtccagtacggaattatgggatctgtttatgcccggcaggttctcggaatcagctcgccccgcgtcggattgttaaatgtcggcacggaagaaaagaaaggaaacgacctgacaaaaaagacgtttgaattattaaaagaaacaaacgtgaattttgtcggaaacgttgaggcgagagacttgctcgaaggcgctgctgacgtcatcgtcacagacggctttacgggcaacgtcacgttgaaaacattggaaggttcagcgttatcgattttcaaaatgctgaaagatacactgacttcaagttttgtttctaagcttgcagcgggcgtgctaaagccgaagctgatggaaatgaaactgaaaatggactattctgagtacggcggggcgagtcttttcggtttgaaagcgcccgtcattaaagcgcacggctcttctgacgcacgcgctgtttaccatgcgctgcgccaggcgagagaaatggtcagccaaaacgtggccgcatttatagaagaagaagtaaaagaagaaaaaacagatgagtagtctggaggttaccgcatcatgagtaagattgcatttttatttcccggacagggatcacaatatatcggcatgggaaaagacctgtacgaacgcgaagaagcgtcaaaacgtatttttgatgaagcggatgaaacgcttgaaacaaagctgagctcgctcatttttgaaggtgacgccgaagaattgacccttacatacaatgcgcagcctgcgctgttgacaacgagcatcgccgtattggaaaagtttaaagaatccggcatcacccctgatttcaccgccggccacagcctcggagaatattcggcgcttgttgcggcgggagcgatgacatttaaagatgccgtttacacggtaagaaaacggggagaattcatgaatgaagccgtgccggccggagaaggcgccatggcagcgattctcggaatggatgcggagtccttgaaaaaggtgacggatcaagtgacggaaaacggtcatctcgtacagcttgcaaatctgaactgccccggccagatcgtcatttccggaacggcaaaaggcgtggagctggcttcagaggaagcgaaaaacaacggagcaaaacgggcgatcccattagaagtaagcggaccgttccattctgaattaatgaagccggcagcgcaaaaactcgaggaggtgctcagcgcctgtgagttaaaaaatgcggctgttcccgtgatttcaaacgtttcggctgacgttatgacggaaaaagacgatatcaagaaaaaactgatcgaacagctgtattcgcctgttcgctttgaagaaaccattaacaaactgattgacgaaggcgtcacgacgtttgttgaaatcgggcccggaaaagtgctttcaggccttgtgaaaaaagtgaaccgccgccttaaaacaatctcggtttctgaccatgaaaccatcgaactggcgattcaaacgctgaaggaggagaatcaggatgcttaatgaaaaaacagcagtggtaacgggagcgtcccgcggaatcggtcgggcgatcgcgcttgatcttgcgaaaaacggctgtaatgtagtagtcaactactccgggaatgaagcgaaagcgaacgaagtcgtagatgagatcaaatctttgggccgaaacgcgatcgccgtaaaagccgatgtatcaaattccgaagaagtacaaaacatgatgaaagaggctgtcgctgcattttcttcaatcgacattctcgtgaacaatgcggggatcacaaaagacaatcttctgatgagaatgaaagaaaatgaatgggatgatgtcattaacattaacttaaaaggtgtattcaactgcacgaaagccgttacaagacagatgatgaaacagcgctccggccggattatcaacgtatcatcaatcgtcggcgtcagcggaaaccccggccaggcaaactatgtggcggcaaaagccggtgtaatcggcttaacgaagtcatcagccaaagagcttgcgagccgaaatattacggtcaatgccattgctccgggctttatttccacggatatgacggacaagctttctaaagaagtccaagatgaaatgctgaagcagattccgctcgcgcgtttcggtgatccttccgatatcagcagcgttgttacgttccttgcttctgaaggatcgcgttatatgacgggccaaacccttcatattgacggcggaatggtgatgtaaagatttgtttttaaaatttcatcctagtttctctagttttttaaaaacgaatcctctataatacttgaggggaggtgaattgctatggcagatacattagagcgtgtaacgaaaatcatcgtagaccgccttggcgttgatgaagctgacgtcaaacttgaagcttctttcaaggaagacttaggtgctgattccctagatgtagttgagcttgttatggaacttgaagacgagtttgatatggagatttctgacgaagatgctgaaaagattgcaacagtcggcgacgctgtgaactacatacaaaaccagcaataagctgatgctaaaagtcccgcctgacagcggggctttagccctttaatcgttcggttaccggcgtctgacgctgtacgcgctgctgattccgtttacggcggggagcgcggtgaacctgatgtgcctatggaggttactatgtcaaaacactcacattttaaagataaaaaaaagttctataaaaaaatagagcaatttaaagagttccaagaacggatttcggttcattttcaaaacgagaaacttttgtatcaagcatttacacattcatcttatgtgaatgagcatcggaaaaagccgtatgaagacaacgaaaggcttgaatttttaggtgacgctgttttggaactgacgatctcccaattcttatttgccaaatatccggccatgagtgaaggagatttgacgaagctgagagccgctatcgtatgcgagccgtcactcgtctcacttgcccacgaattgtcattcggcgatcttgttctcttgggaaaaggagaagaaatgacgggcggcagaaagcgtcctgcgcttttagcggatgtgtttgaagcgtttatcggcgcactgtatctggatcagggccttgagccggttcagcaattcctgaaagagtacgtgttccctaaaataaacgatggtgctttttctcatgtgatggatttcaaaagccagcttcaagaatttgtacagcgggacggaaaaggatcgcttgagtacaaaattctcaatgaaaaagggcctgcccacaaccgggaattcgaggcgctcgtctctcttaaaggtgaggcgctcggtatcgggaacggacgttccaaaaaagaagccgagcagcatgcggcacaggaagctcttgcaaaattgcaaaaacatcatacgaaacaataaaatccccctgtatccctagggggatttcagtatgtctgcgcctgatataagcgggtgattatgataatattgagatacttatacgataaggaggatctgggatgttcctcaaacgtttagacgttataggatttaaatcatttgcagaacggatatccgttgactttgtaaaaggcgtcacggccgttgtcggtccgaacggcagcggaaagagcaacattaccgaagccatccgctgggtgctcggcgaacaatcagcccgctcgcttcggggcggaaaaatggaagatatcatttttgcgggaagtgattcgcgcaagcggctgaaccttgccgaagtcacgttaacgcttgataatgaagatcattttctcccgatcgattatcacgaagtcagcgtgacgaggcgggtgtaccgttccggagaaagtgaatttctcatcaacaatcagcagtgccgcctgaaagacatcattgacttatttatggactccgggctcggaaaagaagcgttctccattatcagccaggggaaagtcgaagagattctcagcagcaaagcggaagaccgccgcagtatttttgaagaagcggccggcgtgctgaaatataaaacacgaaagaaaaaagcggaaaacaaactgtttgagacgcaggataacttaaacagggtggaagatattctccacgagcttgaagatcaggtcgaaccgctgaaaatccaggcatcaatcgccaaagactacttagaaaaaaagaaagagcttgagcatgtcgaaatcgcccttaccgcctttgacatcgaacaactgcatagcagatggtcgggtttaaaagaaaaggtgcagacggcaaaacaagaagaattggcggaatcatcagctctgtccgcaaaagaagcgatgatagaagagacgagagataaaatccacgcgcttgatgaatccgtcaacgaactgcagcaggtgctgctcgtgacaagtgaagagctggaaaagctggaaggccggaaagaagtgctgaaagagcgcaaaaaaaacgccgcgcaaaaccgggaacagctagaggaatccgttacacattacacgaacaaagaagccgaactgaaagcggacattgaaaaacagtctgccgtctatgataaacttcgtgcggaagtgaagcggttaaacgcccaggtgaaagaaaagcagcaggctctcagtctgcataatgaaaatgtagaagagaaaatcgaacaattaaaaagcgattactttgaattgttaaacagccaggcgtcgattcgcaacgagctgcagcttttagatgatcagatgtcccaatctgcggtccagcaggcgagactgaccgcaaacaatgaaaaataccttgaagaacgtaacgatattgcagtccgcaaagcggcgtgcgaagaggaattggccgccgttgaagaggatattcacaatcaggtcgtccgctttcgcgaagtccagacagcatatgaacagaaaaaacgccagtatgaaaagaaagaatcagcgctgtatcaggcatatcaattcgtccagcaggccagatccaaaaaagatatgcttgaaacgatgcaaggcgatttttcaggattttaccaaggcgtaaaagaagtgctgaagcagaaagagcagctcggcggcatccgcggcgccgttctcgaactgattgcgaccgaacaaaaatatgaaacggcgattgagattgcactcggcgcagcggcgcagcacgttgtcacagacgatgagcaggcggcgcggaaagcgattcaatatttaaaacagaattccttcggccgcgcgacgttcctgccgcttacagttatgaaaccgcgccagcttcaaacccgtgatgaacagacggcttcaaagcatccgtctttcctcggcacagcgagcgggcttgtcacatatgatgcggcgtatcggaatgtcattcaaaaccttctcggcaccgtgctgatcactgaagatttaaaaggcgcgaatgaactggccaagcttctcgggcaccgctaccgcatcgtcacgcttgagggcgatgtcgtcaatccaggcggatcaatgacaggcggcgcggtcaaaaagaaaaacaattctctgctcggcagaagccgcgagcttgagacggtgactgcgcggcttgccgaaatggaagaaaaaacagctctgctcgaaaaagaggtcaaagcgctgaagcaggccattcaagagcttgaacatacgctgagcggtctccgtgaagacggtgaggctttcagaacaaagcagcaggatgtaaaaggcaggctgtatgaactcgaagttgctgaaaagaacatcaatacccatctggagctttacgaccaggagaaagcatcactgacggaaagcagccgggaaaaagagacgcgcaaatcagctctggaagaacagctgagtgaggcatccggccagctgaaagagcttgaggaagagatggaaaggctgacaaaacaaaagcagaccctatcctcaacaaaagaaacgctctctcatgaactgacggaatgtaaagtggccgctgcgaaaaaagaacaggcgtgctcgagtgaggaagacaacctcaaaaggctgaaaaaagagcttgaagaaacgcagctcgctctgaaagaaacacgggaagatttaagcctcctgacctcagagatgacgtccagcacaagcggtgaggagcagcttgaagaagcagcccatcataagcttcacgataaaacgagaacgatcgaattgatcgccagccggcgcgaccagcgtgtgaagctccagcgggctcttgatacgaacgagcttgagctgaaagagatgaagcgtctgtacaagcaaaaaacggacattctgaaagatgaagaggtaaaactcggccggatggaagttgagcttgataatctcttgcagtatttacgcgaggagtacagcttatcctttgaaggggcaaaagaacaatatcagcttgaactcgagcctgaagaggcgagaaaacgggtcaaactgatcaagctttcaattgaagagctcggaacggtcaatctcggcagcatcgatgagtttgaaagagtaaacgaacggtatcagtttttaacagagcagaaaaatgacctgacggaagcgaaaaacacactgtttcaagtcattgaagaaatggattctgaaatgacgaagcgattccatgaaacgtttatccagatccgttctcaattcaacgacgtgttccgttctttattcggaggaggacgggctgaactgaagctgactgatccgaatgatcttcttaattccggggtggacattatcgcgcagcctccgggcaaaaaactgcaaaacttaaatcttttgtcagggggagaacgggcgctgactgccattgcccttttattctctattctgaaagtaaggcccgtgccgttctgcgtccttgatgaagtggaagctgcgcttgatgaagccaatgtattcaggtttgcgcaatatttaaaaaaatacagcggcgacagccagtttatcgtcatcacccacagaaaaggcaccatggaagaagcggatgtcctctacggtgttacgatgcaggaatccggcgtttcccgaatggtttcggtcaaactggaagaaacaaaagaatttattcagtaacgaggaaagaggttgaaagatgagcttttttaaaaaattaaaagagaaaatcacgaaacagacagactccgtctctgaaaaatttaaagatggtcttgaaaaaacaagaaattccttctcaaataaagtgaacgaactcgtctcccgctaccggaaagtcgacgaggatttcttcgaggagcttgaggaagtgctgattggcgctgacgtaggttttacaaccgtcatggagctgattgatgagctcaaaaaagaagtgaagctgaaaaacattcaggatcctcaggaagtgcagtccgtcatttctgaaaagcttgtcgacatttataacagcggcgacgaacagatttctgaattaaatattcaggacgggcgcctgaacgttattctgcttgtcggggtaaacggcgtcggaaaaacgacaacgatcggaaaacttgcccataagctgaagaatgaaggcaaatccgttgtgctcgctgccggagacactttcagagccggggcgattgaacagcttgaagtgtggggggagcgtacaggcgtgcctgtcattaagcaggctgccggaagcgaccctgcggcggttatttatgatgccgtacacgcggctaaagcaagaggagcggatgtgctgatttgtgatacggccggccgccttcagaataaagttaacttaatgaaagagcttgaaaaggtcaaacgcgtcattgaacgcgaagtgcctgaggccccgcatgaggttctccttgcgctggacgcgacgacaggccagaatgcgatggcgcaggcgaaagaattctccaaagcgacgaatgtgacgggtatcgcattaacgaagcttgacggcaccgcaaaaggcggtatcgtcctggcgatccgcaatgagcttcacatccctgtgaaactggtcggcctcggagaaaaggttgacgatctccagcggtttgatgcagaatcttacgtatacggtctcttttcggatttagttgaaaaagccgaagattaatgaataaaaaacgagtataaaatggacggttttatactcgtttttttatacgcattgatagatcggaatggaggggcagttgttggacaaatggctgaaagctgaattggaaagtaagatcggcgcgataaaccatatgtcgctgctggatgaacagggaggcacttcaaccgttcgaaaaatagtgaccggtcaagacgcatttttgctgaaaagttcttttcaacagaagtatcgggaatggttaatgagagaagccttcgttttacaacaactgacggaaactcgtcgtctgcctgttcctatttactatgggatgatacaggaacagcatgccagccatatcatcatgtcatttgaggatggaatcaccctgacttcggctttaagaaaagccaaaggggatactgaaaagaaaaagctgatcaaaagtttcggccagtttctgcagcggctgcatgaaaccgaaatggtctctggtttacagccggaaacagactggctcgatctgcaaatcaaacgagccggggaatatgtcaaaaaaggacaagctgaaggaagtgcagagcttttgaaggaattggacaggtacaggcctgttcctgttcagcagacaatgattcacggtgactgcacgactgataatgtgctggtgagagacggagaggtctatctgtttatcgatgctgcgggaatatcggcgggagatccgcgttatgatgaatcattagcgatcagtcgttttgtcacaaatgaatcatgtctcaatgctttttacgaaggctattgccgctatcgtgtatcaaaacaagaattcgagtattttaacgacggtctgtatgaatttttttgaaaacacttattatgtaaaaagagcatcctgctttgacaagataaaaacttgacacacgctctgaaaccatgtaaactaagtttttgtaaagggatttgacttaacaaaggggagagctcaaatgtcgctcgaaaaaacgacgagaatgaactatttgtttgacttctatcagtcgttgctgacgtcaaaacaaaagagctatatgtcgctttattatctggacgatttctcccttggtgaaatagccgaagagtatgacgtttcaaggcaagccgtttacgataacatcaaacggactgaagcgatgcttgaacaatatgaagaaaaactgctcctttttaaaaagtttcaggagcgtaaagaaatgtttacaaagctgaaagagcttgcttccggcttgcaggaagaggaaaaaatgacggctctgattgaagcgcttgagaaattagattaggaggcggcaaacaatggcatttgaaggattagccgaccgactgcaaaagacgatttcaaaaatccgcggaaaaggaaaagtcagcgaacaagacgtaaaagagatgatgcgtgaagtccgtcttgcgcttcttgaggctgacgttaactttaaagtcgtaaaggattttgtgaaaaaagtaagtgaacgggctgtcgggcaggacgtcatgcagagtctgacacccggtcagcaggttattaaagtcgtaaaagaagagcttaccgagctgatgggcggcgaagaaagcaaaattgccgccgccaaacgcccgccgaccgttattatgatggtcgggctccaaggtgccggtaaaacgacaaccacggggaagcttgccaacctgctgcgcaaaaaacataaccgcaaaccgctgctcgtggctgcggatatttaccgccccgccgcgattaaacagctggaaacactggggaaacagcttgatatgccggtcttttcgcttggcgatcaggtcagcccggtggaaattgccagacaggcgattgaaaaagcgaaggaagagcatcatgattatgtgattttagataccgccggacggctgcacatcgatcatgaactgatggatgagctctccggcgtaaaggaagtcgcaaatcctgaggaaattttccttgtcgtcgactcaatgaccggtcaggatgcggtaaacgtcgccaaaagctttaatgaccagctcggtttaacgggcgtcattttaacaaagcttgacggggatacccgcggaggtgcggcgctttctatccgcgcggtcaccgaaacgccgattaaattcgccggaatgggagaaaagctcgatgctcttgaagcgttccatcctgaacggatggcatcccggattctcggaatgggtgacgtgctgacgctgattgaaaaagctcaggcgaccgttgatgaagacaaagccaaagagcttgagcagaaaatgagaacgatgagcttcacattggatgattttctggagcagctcggccaggtccgaaacatggggcctcttgacgaactgctgcaaatgatgcccggagcaggcaaaatgaaaggcttaaaaaacatccaagtcgatgaaaaacagctgaatcatgtggaagcgatcattaaatcaatgactgttcttgaaaaagaacagccggatattattaacgccagccggcggaagcggattgccaaaggaagcggaacatccgttcaggaagtcaaccgtcttttaaagcagtttgaggaaatgaaaaaaatgatgaagcagatgaccaacatgtcaaaagggaagaaaaaaggctttaaattaccttttatgtaatcggttatacatgataaaaccgttgttaagaaaaaacactttacaaacacttttatcattgttaatatactatcttgttgaaatattttcggaggtgctagtaaaatggcagtaaaaattcgtttaaaacgtatgggagcaaaaaaatctcctttctatcgtattgttgtagcagattctcgttcaccgcgtgacggccgtttcatcgaaacagtcggcacatacaacccggttgcaaagccggctgaagtgaaaatcaatgaagagcttgctcttaaatggcttcaaacaggagctaaaccttctgatacagtccgcaacttgttctcaagccaaggaattatggaaaaattccacaacgctaaacaaggcaagtaatgactgatcagaacttggaagatttgattgtcagcattgtggctccgcttgtcgaccatccggaagacataacggtcacaaaggaagagactgatcaaaagattgcgctacgcttatctgtcaataagtcggataccggtaagattatcggaaagcaaggccggactgcaagagcgattcgaaccgtcgtttttgcagctggcgcacagtcttctaagaaagttcaatttgaaatatttgactgaaaaagggagagggccggcacctcccctttttttacacgt
